United States Patent
zur Megede et al.

(10) Patent No.: US 7,211,659 B2
(45) Date of Patent: May 1, 2007

(54) POLYNUCLEOTIDES ENCODING ANTIGENIC HIV TYPE C POLYPEPTIDES, POLYPEPTIDES AND USES THEREOF

(75) Inventors: Jan zur Megede, San Francisco, CA (US); Susan Barnett, San Francisco, CA (US)

(73) Assignee: Chiron Corporation, Emeryville, CA (US)

( * ) Notice: Subject to any disclaimer, the term of this patent is extended or adjusted under 35 U.S.C. 154(b) by 0 days.

(21) Appl. No.: 10/190,435

(22) Filed: Jul. 5, 2002

(65) Prior Publication Data

US 2003/0143248 A1    Jul. 31, 2003

Related U.S. Application Data

(60) Provisional application No. 60/349,871, filed on Jan. 16, 2002, provisional application No. 60/316,860, filed on Aug. 31, 2001, provisional application No. 60/303,192, filed on Jul. 5, 2001.

(51) Int. Cl.
| | |
|---|---|
| *C07H 21/04* | (2006.01) |
| *A61K 39/21* | (2006.01) |
| *C12P 19/04* | (2006.01) |
| *A61K 49/00* | (2006.01) |
| *A61K 38/00* | (2006.01) |
| *A61K 39/12* | (2006.01) |
| *C12Q 1/68* | (2006.01) |
| *C12Q 1/70* | (2006.01) |

(52) U.S. Cl. ............... 536/23.72; 424/9.2; 424/192.1; 424/199.1; 424/208.1; 435/5; 435/6; 435/69.7; 435/70.1; 536/23.4

(58) Field of Classification Search ............. 404/192.1, 404/199.1, 208.1; 536/23.4, 23.72; 435/5, 435/6, 69.7, 40.1; 424/9.7
See application file for complete search history.

(56) References Cited

U.S. PATENT DOCUMENTS

| | | |
|---|---|---|
| RE33,653 E | 7/1991 | Mark et al. |
| 5,032,510 A | 7/1991 | Kovacevic et al. |
| 5,128,319 A | 7/1992 | Arlinghaus |
| 5,256,767 A | 10/1993 | Salk et al. |
| 5,304,472 A | 4/1994 | Bass et al. |
| 5,364,773 A | 11/1994 | Paoletti et al. |
| 5,419,900 A | 5/1995 | Lane et al. |
| 5,503,833 A | 4/1996 | Redmond et al. |
| 5,550,280 A | 8/1996 | Dao-Cong et al. |
| 5,637,677 A | 6/1997 | Greene et al. |
| 5,665,569 A | 9/1997 | Ohno |
| 5,665,720 A | 9/1997 | Young et al. |
| 5,670,152 A | 9/1997 | Weiner et al. |
| 5,683,864 A | 11/1997 | Houghton et al. |
| 5,686,078 A | 11/1997 | Becker et al. |
| 5,693,755 A | 12/1997 | Buonagurio et al. |
| 5,712,088 A | 1/1998 | Houghton et al. |
| 5,714,596 A | 2/1998 | Houghton et al. |
| 5,728,520 A | 3/1998 | Weiner et al. |
| 5,741,492 A | 4/1998 | Hurwitz et al. |
| 5,750,373 A | 5/1998 | Garrard et al. |
| 5,766,845 A | 6/1998 | Weiner et al. |
| 5,817,637 A | 10/1998 | Weiner et al. |
| 5,837,242 A | 11/1998 | Holliger et al. |
| 5,837,818 A | 11/1998 | Buonagurio et al. |
| 5,853,736 A | 12/1998 | Becker et al. |
| 5,858,675 A | 1/1999 | Hillman et al. |
| 5,866,320 A | 2/1999 | Rovinski et al. |
| 5,871,747 A | 2/1999 | Gengoux-Sedlik et al. |
| 5,879,907 A | 3/1999 | Aberg et al. |
| 5,879,925 A | 3/1999 | Rovinski et al. |
| 5,889,176 A | 3/1999 | Rovinski et al. |
| 5,932,445 A | 8/1999 | Lal et al. |
| 5,951,975 A | 9/1999 | Falo, Jr. et al. |
| 5,955,342 A | 9/1999 | Rovinski et al. |
| 5,965,726 A | 10/1999 | Pavlakis et al. |
| 5,972,596 A | 10/1999 | Pavlakis et al. |
| 6,001,977 A | 12/1999 | Chang et al. |
| 6,004,763 A | 12/1999 | Gengoux et al. |
| 6,025,125 A | 2/2000 | Rovinski et al. |
| 6,060,273 A | 5/2000 | Dirks et al. |
| 6,060,587 A | 5/2000 | Weiner et al. |
| 6,063,384 A | 5/2000 | Morrow et al. |
| 6,074,636 A | 6/2000 | Nichols |
| 6,080,408 A | 6/2000 | Rovinski et al. |
| 6,087,486 A | 7/2000 | Weiner et al. |
| 6,093,800 A | 7/2000 | Reiter et al. |
| 6,096,505 A | 8/2000 | Selby et al. |
| 6,099,847 A | 8/2000 | Tobin et al. |
| 6,114,148 A | 9/2000 | Seed et al. |
| 6,132,973 A | 10/2000 | Lal et al. |
| 6,139,833 A | 10/2000 | Burgess et al. |
| 6,140,059 A | 10/2000 | Schawaller |
| 6,146,635 A | 11/2000 | Cano et al. |
| 6,172,201 B1 | 1/2001 | Weiner et al. |
| 6,174,666 B1 | 1/2001 | Pavlakis et al. |
| 6,214,804 B1 | 4/2001 | Felgner et al. |
| 6,291,157 B1 | 9/2001 | Rovinski et al. |
| 6,291,664 B1 | 9/2001 | Pavlakis et al. |
| 6,316,253 B1 | 11/2001 | Innis et al. |
| 6,331,404 B1 | 12/2001 | Berman et al. |

FOREIGN PATENT DOCUMENTS

EP    0187041    7/1986

(Continued)

OTHER PUBLICATIONS

Riffkin et al. A single amino-acid change between the antigenically different extracellular serine protease V2 and B2 from *Dichelobacter nodous.* Gene (1955) vol. 167, pp. 279-283.*

(Continued)

*Primary Examiner*—Ulrike Winkler
(74) *Attorney, Agent, or Firm*—Helen Lee; Dahna S. Pasternak; Alisa A. Harbin

(57) ABSTRACT

The present invention relates to polynucleotides encoding immunogenic HIV polypeptides. Uses of the polynucleotides in applications including immunization, generation of packaging cell lines, and production of HIV polypeptides are also described. Polynucleotides encoding antigenic HIV polypeptides are described, as are uses of these polynucleotides and polypeptide products therefrom, including formulations of immunogenic compositions and uses thereof.

47 Claims, 158 Drawing Sheets

FOREIGN PATENT DOCUMENTS

| | | |
|---|---|---|
| EP | 0199301 A1 | 10/1986 |
| EP | 0242216 | 10/1987 |
| EP | 0314317 A1 | 5/1989 |
| EP | 0449116 B1 | 10/1991 |
| EP | 0617132 A2 | 9/1994 |
| EP | 0449116 B1 | 10/1999 |
| WO | WO 86/03224 | 6/1986 |
| WO | WO 87/02775 | 5/1987 |
| WO | WO 88/00471 | 1/1988 |
| WO | WO 88/10300 | 12/1988 |
| WO | WO 89/01940 | 3/1989 |
| WO | WO 89/02277 | 3/1989 |
| WO | WO 89/02922 | 4/1989 |
| WO | WO 89/03222 | 4/1989 |
| WO | WO 90/02568 | 3/1990 |
| WO | WO 90/03984 | 4/1990 |
| WO | WO 90/10438 | 9/1990 |
| WO | WO 90/11092 | 10/1990 |
| WO | WO 90/11359 | 10/1990 |
| WO | WO 90/12094 | 10/1990 |
| WO | WO 90/15141 | 12/1990 |
| WO | WO 91/04273 | 4/1991 |
| WO | WO 91/06319 | 5/1991 |
| WO | WO 91/07425 | 5/1991 |
| WO | WO 91/07510 | 5/1991 |
| WO | WO 91/13360 | 9/1991 |
| WO | WO 91/13906 | 9/1991 |
| WO | WO 91/15238 | 10/1991 |
| WO | WO 91/15512 | 10/1991 |
| WO | WO 91/16926 | 11/1991 |
| WO | WO 91/18928 | 12/1991 |
| WO | WO 91/19803 | 12/1991 |
| WO | WO 92/03475 | 3/1992 |
| WO | WO 92/04046 | 3/1992 |
| WO | WO 92/05799 | 4/1992 |
| WO | WO 93/02102 | 2/1993 |
| WO | WO 93/04090 | 3/1993 |
| WO | WO 93/08836 | 5/1993 |
| WO | WO 93/14789 | 8/1993 |
| WO | WO 93/20212 | 10/1993 |
| WO | WO 93/21346 | 10/1993 |
| WO | WO 93/23569 | 11/1993 |
| WO | WO 94/04574 | 3/1994 |
| WO | WO 94/07922 | 4/1994 |
| WO | WO 94/11523 | 5/1994 |
| WO | WO 94/13804 | 6/1994 |
| WO | WO 94/15621 | 7/1994 |
| WO | WO 94/16060 | 7/1994 |
| WO | WO 94/16737 | 8/1994 |
| WO | WO 94/18221 | 8/1994 |
| WO | WO 94/20141 | 9/1994 |
| WO | WO 94/26040 | 9/1994 |
| WO | WO 94/22477 | 10/1994 |
| WO | WO 94/26293 | 11/1994 |
| WO | WO 94/29339 | 12/1994 |
| WO | WO 95/03407 | 2/1995 |
| WO | WO 95/04818 | 2/1995 |
| WO | WO 95/11317 | 4/1995 |
| WO | WO 95/11701 | 5/1995 |
| WO | WO 95/24485 | 9/1995 |
| WO | WO 95/25124 | 9/1995 |
| WO | WO 95/27505 | 10/1995 |
| WO | WO 95/29700 | 11/1995 |
| WO | WO 95/33206 | 12/1995 |
| WO | WO 95/33835 | 12/1995 |
| WO | WO 96/02273 | 2/1996 |
| WO | WO 96/02557 | 2/1996 |
| WO | WO 96/04382 | 2/1996 |
| WO | WO 96/09066 | 3/1996 |
| WO | WO 96/09378 | 3/1996 |
| WO | WO 96/16178 | 5/1996 |
| WO | WO 96/20732 | 7/1996 |
| WO | WO 96/23509 | 8/1996 |
| WO | WO 96/25177 | 8/1996 |
| WO | WO 96/40290 | 12/1996 |
| WO | WO 97/03198 | 1/1997 |
| WO | WO 97/11605 | 4/1997 |
| WO | WO 97/26009 | 7/1997 |
| WO | WO 97/31115 | 8/1997 |
| WO | WO 98/08539 | 3/1998 |
| WO | WO 98/41536 | 9/1998 |
| WO | WO 98/41645 | 9/1998 |
| WO | WO 98/43182 | 10/1998 |
| WO | WO 98/48843 | 11/1998 |
| WO | WO 98/59074 | 12/1998 |
| WO | WO 99/02694 | 1/1999 |
| WO | WO 99/06599 | 2/1999 |
| WO | WO 99/09412 | 2/1999 |
| WO | WO 99/12416 | 3/1999 |
| WO | WO 99/13864 | 3/1999 |
| WO | WO 99/16883 | 4/1999 |
| WO | WO 99/33346 | 7/1999 |
| WO | WO 99/41397 | 8/1999 |
| WO | WO 99/41398 | 8/1999 |
| WO | WO 99/52463 | 10/1999 |
| WO | WO 99/53960 | 10/1999 |
| WO | WO 99/67395 | 12/1999 |
| WO | WO 00/08043 | 2/2000 |
| WO | WO 00/15819 | 3/2000 |
| WO | WO 00/18929 | 4/2000 |
| WO | WO 00/21556 | 4/2000 |
| WO | WO 00/39302 | 7/2000 |
| WO | WO 00/39303 | 7/2000 |
| WO | WO 00/39304 | 7/2000 |
| WO | WO 00/44926 | 8/2000 |
| WO | WO 00/65076 | 11/2000 |
| WO | WO 00/66179 | 11/2000 |
| WO | WO 00/67761 | 11/2000 |
| WO | WO 00/67787 | 11/2000 |
| WO | WO 00/71561 | 11/2000 |
| WO | WO 01/02607 | 1/2001 |
| WO | WO 01/12223 | 2/2001 |
| WO | WO 01/16342 | 3/2001 |
| WO | WO 01/19958 | 3/2001 |
| WO | WO 01/21270 | 3/2001 |
| WO | WO 01/26681 | 4/2001 |
| WO | WO 01/29225 | 4/2001 |
| WO | WO 01/36614 | 5/2001 |
| WO | WO 01/42308 | 6/2001 |
| WO | WO 01/43693 | 6/2001 |
| WO | WO 01/45748 | 6/2001 |
| WO | WO 01/46408 | 6/2001 |
| WO | WO 01/47955 | 7/2001 |
| WO | WO 01/54701 | 8/2001 |
| WO | WO 01/54719 | 8/2001 |
| WO | WO 01/60393 | 8/2001 |
| WO | WO 01/60838 | 8/2001 |
| WO | WO 02/04493 A2 | 1/2002 |

OTHER PUBLICATIONS

Ngo et al, in The Protein Folding Problem and Tertiary Structure Prediction, 1994, Edited by Merz et al., (ed.), Birkhauser, Boston, MA, pp. 433 and 492-495.*

Burgess et al. Possible dissociation of the heparin-binding and mitogenic activities of heparin binding growth factor-1 from its receptor-binding activities by site directed mutagenesis of a single lysine residue. Journal of Cell Biology. (1990) vol. 111.*

Lazar et al. Transforming growth factor alpha; mutations of aspartic acid 47 and leucine 48 results in different biological activities. Molecular and Cellular Biology (1988) vol. 8, No. 3, p. 1247-1252.*

Tao et al. Studies of aglycosylated chimeric mouse-human IgG. The Journal of Immunology (1989) vol. 143 No. 8, p. 2595-2601.*

Abaza et al. Effects of amino acid substitutions outside an antigenic site on protein binding to monoclonal antibodies of predetermined specificity obtained by peptide immunization. Journal of Protein Chemistry (1992) vol. 11, No. 5, pp. 433-444.*
Nuss et al. Defining the requirements for an antibody epitope on influenza virus neuraminidase: How Tolarant are protein epitopes? Journal of Molecular Biology (1994) vol. 235, pp. 747-759.*
di Marzo et al. Loss of a neutralizing epitope by a spontaneous point mutation In the V3 loop of HIV-1 isolated from an infected laboratory worker. Journal of Biological Chemistry (Dec. 1993) vol. 268, No. 34, pp. 25894-25901.*
Baker et al., Protein structure prediction and structural gemonics. Science (2001) vol. 294, No. 5540, pp. 93-96.*
Attwood, T. The babel of bioinformatics. Science (2000) vol. 290, No. 5491, pp. 471-473.*
Freed EO. HIV-1 gag proteins: diverse functions in the virus life cycle. Virology (1998) vol. 251, No. 1, pp. 1-15.*
Nabel, "HIV vaccine strategies,"*Vaccine* 20:1945-1947, 2002.
O'Hagan et al., "Induction of potent immune responses by cationic microparticles with adsorbed human immunodeficiency virus DNA vaccines," *J. Virology* 75(19):9037-9043, 2001.
McCluskie et al., "Route and Method of Delivery of DNA Vaccine Influence Immune Responses in Mice and Non-Human Primates," *Molecular Medicine* 5: 287-300, 1999.
GenBank accession No. AF110965.
GenBank accession No. AF110967.
GenBank accession No. AF110968.
GenBank accession No. AF110975.
GenBank accession No. M65024.
Adams et al., "The Expression of Hybrid Hiv:ty Virus-like Particles in Yeast," *Nature* 329:68-70 (1987).
Anderson, et al., "Human Gene Therapy," *Nature* 392(6679 Suppl):25-30 (1998).
Arthur, et al., "Serological Responses in Chimpanzees Inoculated with Human Immunodeficiency Virus Glycoprotein (Gp120) Subunit Vaccine," *Proc Natl Acad Sci USA* 84(23):8583-8587 (1987).
Azevedo et al., "Main Features of DNA-Based Immunization Vectors," *Braz J Med Biol Res.* 32(2):147-153 (1999).
Baker et al., "Structures of Bovine and Human Papillomaviruses. Analysis by Cryoelectron Microscopy and Three-dimensional Image Reconstruction," *Biophys. J.* 60:1445-456 (1991).
Barr, et al., "Antigenicity and Immunogenicity of Domains of the Human Immunodeficiency Virus (HIV) Envelope Polypeptide Expressed in the Yeast *Saccharomyces cerevisiae," Vaccine* 5(2):90-101 (1987).
Barrett, et al., "Large-scale production and purification of a vaccinia recombinant-derived HIV-1 gp160 and analysis of its immunogenicity," *AIDS Res Hum Retroviruses* 5(2):159-71 (1989).
Beard, W. A., et al., "Role of the "Helix Clamp" in HIV-1 Reverse Transcriptase Catalytic Cycling as Revealed by Alanine-Scanning Mutagenesis," *Journal Of Biological Chemistry* 271(21):12213-12220 (1996).
Berger, P.B., "New Directions in Research: Report from the 10th International Conference on AIDS," *Canadian Medical Association Journal* 152(12):1991-1995 (1995).
Berman, et al., "Human Immunodeficiency Virus Type 1 Challenge of Chimpanzees Immunized with Recombinant Envelope Glycoprotein gp120," *Proc Natl Acad Sci USA* 85(14):5200-5204 (1988).
Berman, et al., "Expression and Immunogenicity of the Extracellular Domain of the Human Immunodeficiency Virus Type 1 Envelope Glycoprotein, gp160," *J Virol.* 63(8):3489-3498 (1989).
Birx and Redfield, "HIV Vaccine Therapy," *Int J Immunopharmacol.* 13(1):129-132 (1991).
Bolognesi, D.P., "Progress in Vaccines Against AIDS," *Science* 246:1233-1234 (1989).
Borrow, et al., "Virus-Specific CD8+ Cytotoxic T-Lymphocyte Activity Associated with Control of Viremia in Primary Human Immunodeficiency Virus Type 1 Infection," *J Virol.* 68(9):6103-6110 (1994).
Bourgault, et al., "Cytotoxic T-Cell Response and AIDS-Free Survival in Simian Immunodeficiency Virus-Infected Macaques," *AIDS.* 7 (Suppl 2):S73-S79 (1993).
Brown et al., "Chimeric Parvovirus B19 Capsids for the Presentation of Foreign Epitopes," *Virology* 198:477-488 (1994).
Bujacz, G., et al., "The Catalytic Domain of Human Immunodeficiency Virus Integrase: Ordered Active Site in the F185H Mutant," *Febs Letters* 398(2-3):175-178 (1996).
Burton et al., "Why Do We Not Have an HIV Vaccine and How Can We Make One?" *Nat Med.* 4(5 Suppl):495-498 (1998).
Carmichael et al., "Quantitative Analysis of the Human Immunodeficiency Virus Type 1 (Hiv-1)-specific Cytotoxic T Lymphocyte (Ctl) Response at Different Stages of Hiv-1 Infection: Differential Ctl Responses to Hiv-1 and Epstein-barr Virus in Late Disease," *J Exp Med.* 177(2):249-256 (1993).
Chazal N. et al., "Phenotypic Characterization of Insertion Mutants of the Human Immunodeficiency Virus Type 1 Gag Precursor Expressed in Recombinant Baculovirus-infected Cells," *Virology* 68(1):111-122 (1994).
Ciernik et al., "Induction of Cytotoxic T Lymphocytes and Antitumor Immunity with Dna Vaccines Expressing Single T Cell Epitopes," *J. Immunol.* 156(7):2369-2375 (1996).
Clavel et al., "Isolation of a New Human Retrovirus from West African Patients with AIDS," *Science* 233:343-346 (1986).
Clavel et al., "Molecular Cloning and Polymorphism of the Human Immune Deficiency Virus Type 2," *Nature* 324:691-695 (1986).
Daar et al, "Transient High Levels of Viremia in Patients with Primary Human Immunodeficiency Virus Type 1 Infection," *N Engl J Med.* 324(14):961-964 (1991).
Davey et al., "Subcutaneous and administration of interleukin-2 in human immunodeficiency virus type 1-infected persons," *J Infect Dis.* 175(4):781-789 (1997).
Davies J. F., et al., "Crystal structure of the ribonuclease H domain of HIV-1 reverse transcriptase," *Science* 252(5002):88-95 (1991).
Deminie et al., "Evaluation of Reverse Transcriptase and Protease Inhibitors in Two-drug Combinations Against Human Immunodeficiency Virus Replication," *Antimicrob Agents Chemother.* 40(6):1346-1351 (1996).
Desai et al., "Molecular Cloning and Primary Nucleotide Sequence Analysis of a Distinct Human immunodeficiency Virus Isolate Reveal Significant Divergence in its Genomic Sequence," *Proc. Natl. Acad. Sci. USA* 83:8380-8384 (1986).
Doe et al., "Induction of HIV-1 Envelope (gp120)-Specific Cytotoxic T Lymphocyte Responses in Mice by Recombinant CHO Cell-Derived gp120 is Enhanced by Enzymatic Removal of N-Linked Glycans," *Eur. J. Immunol.* 24:2369-2376 (1994).
Doe, B. and Walker, C.M. "HIV-1 p24 Gag-Specific Cytotoxic T-Lymphocyte Responses in Mice," *AIDS* 10(7):793-794 (1996).
Dyda F., et al., "Crystal Structure of the Catalytic Domain of HIV-1 Integrase: Similarity to Other Polynucleotidyl Transferases," *Science* 266(5193):1981-1986 (1994).
Earl et al., "Isolate-and Group-specific Immune Responses to the Envelope Protein of Human Immunodeficiency Virus Induced by a Live Recombinant Vaccinia Virus in Macaques," *AIDS Res Hum Retroviruses* 5(1):23-32 (1989).
Edelman, R., "Vaccine Adjuvants," *Rev Infect Dis.* 2(3):370-383 (1980).
Engelman, A. et al., "Structure-based Mutagenesis of the Catalytic Domain of Human Immunodeficiency Virus Type 1 Integrase," *Journal Of Virology* 71(5):3507-3514 (1997).
Esnouf et al., "Mechanism of Inhibition of HIV-1 Reverse Transcriptase by Nonnucleoside Inhibitors," *Structural Biology* 2(4)303-308 (1995).
Evans et al., "An Engineered Poliovirus Chimaera Elicits Broadly Reactive Hiv-1 Neutralizing Antibodies," *Nature* 339(6223):385-388 (1989).
Faust et al., "Outpatient Biopsies of the Palatine Tonsil: Access to Lymphoid Tissue for Assessment of Human Immunodeficiency Virus RNA Titers," *Otolaryngol Head Neck Surg.* 114(4):593-598 (1996).
Fennie et al., "Model for Intracellular Folding of the Human Immunodeficiency Virus Type 1 gp120," *J Virol.* 63(2):639-646 (1989).
Ferre et al., "Combination Therapies Against HIV-1 Infection:Exploring the Concept of Combining Antiretroviral Drug Treatments with HIV-1 Immune-Based Therapies in Asymptomatic Individuals," *AIDS Patient Care STDS* 10(6):357-361 (1996).
Fisher, et al., "Biologically diverse molecular variants within a single HIV-1 isolate," *Nature* 334:444-447 (1988).
Fox et al., "No Winners Against AIDS," *Bio/Technology* 12(2):128 (1994).
Garnier, L. et al., "Particle Size Determinants in the Human Immunodeficiency Virus Type 1 Gag Protein," *J Virol* 72(6):4667-4677 (1998).
Goldgur, Y. et al., "Three New Structures of the Core Domain of HIV-1 Integrase: an Active Site That Binds Magnesium," *Proceedings Of the National Academy Of Sciences Of the United States Of America* 95(16):9150-9154 (1998).
Goudsmit et al., "Human Immunodeficiency Virus Type 1 Neutralization Epitope with Conserved Architecture Elicits Early Type-specific Antibodies in Experimentally Infected Chimpanzees," *Proc. Natl. Acad. Sci. USA* 85:4478-4482 (1988).
Greene, "AIDS and the Immune System" *Scientific American* Sep.:99-105 (1993).
Griffiths J.C. et al., "Hybrid Human Immunodeficiency Virus Gag Particles as an Antigen Carrier System: Induction of Cytotoxic T-cell and Humoral Responses by a Gag:V3 Fusion," *J. Virol.* 67(6):3191-3198 (1993).
Grimison B. and Laurence, J., "Immunodominant Epitope Regions of HIV-1 Reverse Transcriptase: Correlations with HIV-1+ Serum IgG Inhibitory to Polymerase Activity and With Disease Progression," *Journal Of Acquired Immune Deficiency Syndromes and Human Retrovirology* 9(1):58-68 (1995).
Gurgo et al., "Envelope Sequences of Two New United States HIV-1 Isolates," *Virology* 164:531-536 (1988).
Gurunathan et al., "CD40 Ligand/Trimer DNA Enhances Both Humoral and Cellular Immune Responses and Induces Protective Immunity to Infectious Tumor Challenge," *J Immunol.* 161(9):4563-4571 (1998).
Guyader et al., "Genome Organization and Transactivation of the Human Immunodeficiency Virus Type 2," *Nature* 326:662-669 (1987).
Hagensee et al., "Three-dimensional Structure of Vaccinia Virus-produced Human Papillomavirus Type 1 Capsids," *J. Virol.* 68:4503-4505 (1994).
Hahn et al., "Genetic Variation in HTLV-III/LAV Over Time in Patients with AIDS or at Risk for AIDS," *Science* 232:1548-1553 (1986).
Hammer et al., "Issues in Combination Antiretroviral Therapy: a Review," *J Acquir Immune Defic Syndr.* 7(Suppl 2):S24-S37 (1994).
Haynes et al., "Update on the Issues of Hiv Vaccine Development," *Ann Med.* 28(1):39-41 (1996).
Haynes et al., "Toward an Understanding of the Correlates of Protective Immunity to Hiv Infection" *Science* 271:324-328 (1996).
Heeney et al., "Beta-chemokines and Neutralizing Antibody Titers Correlate with Sterilizing Immunity Generated in HIV-1 Vaccinated Macaques," *Proc Natl Acad Sci USA* 95(18):10803-10808 (1998).
Hickman, A. B., et al., "Biophysical and enzymatic properties of the catalytic domain of HIV-1 integrase," *Journal Of Biological Chemistry* 269(46):29279-29287 (1994).
Ho et al., "Human Immunodeficiency Virus Neutralizing Antibodies Recognize Several Conserved Domains on the Envelope Glycoproteins," *J Virol.* 61(6):2024-2028 (1987).
Jacobo-Molina, A. et al., "Crystal Structure of Human Immunodeficiency Virus Type 1 Reverse Transcriptase Complexed with Double-stranded DNA at 3.0 A Resolution Shows Bent DNA," *Proceedings Of the National Academy Of Sciences Of the United States Of America* 90(13):6320-6324 (1993).
Katz, R. A. and Skalka, A. M., "The Retroviral Enzymes," *Annual Review Of Biochemistry* 63:133-73 (1994).
Keefer, et al., "Safety and Immunogenicity of Env 2-3, a Human Immunodeficiency Virus Type 1 Candidate Vaccine, in Combination with a Novel Adjuvant, MTP-PE/MF59. NIAID AIDS Vaccine Evaluation Group," *AIDS Res Hum Retroviruses.* 12(8):683-693 (1996).
Kirnbauer et al., "Efficient Self-assembly of Human Papillomavirus Type 16 L1 and L1-L2 into Virus-Like Particles," *J. Virol.* 67:6929-6936 (1993).

Klenerman, et al., "Original Antigenic Sin Impairs Cytotoxic T Lymphocyte Responses to Viruses Bearing Variant Epitopes," *Nature* 394(6692):482-485 (1998).
Koff et al., "Development and Testing of AIDS Vaccines," *Science* 241:426-432 (1988).
Koff and Schultz, "Progress and Challenges Toward and AIDS Vaccine: Brother, Can You Spare a Paradigm?" *J. Clinical Immunology* 16(3):127-133 (1996).
Kohl et al., "Active Human Immunodeficiency Virus Protease Is Required for Viral Infectivity," *PNAS USA* 85:4686-4690 (1988).
Kohlstaedt, L. A. et al., "Crystal Structure at 3.5 A Resolution of HIV-1 Reverse Transcriptase Complexed with an Inhibitor," *Science* 256(5065):1783-1790 (1992).
Koup et al., "Temporal Association of Cellular Immune Responses with the Initial Control of Viremia in Primary Human Immunodeficiency Virus Type 1 Syndrome," *J Virol.* 68(7):4650-4655(1994).
Kovacs et al., "Increases in CD4 T Lymphocytes with Intermittent Courses of Interleukin-2 in Patients with Human Immunodeficiency Virus Infection," *New England J. Med.* 332(9):567-575 (1995).
Kovacs et al., "Controlled Trial of Interleukin-2 Infusions in Patients Infected with the Human Immunodeficiency Virus," *N Engl J Med.* 335(18):1350-1356 (1996).
Krausslich et al., "Processing of in Vitro-synthesized Gag Precursor Proteins of Human Immunodeficiency Virus (HIV) Type 1 by HIV Proteinase Generated in *Escherichia coli,*" *J. Virol.* 62:4393-4397 (1988).
Kreuter J., et al., "Mode of Action of Immunological Adjuvants: Some Physicochemical Factors Influencing the Effectivity of Polyacrylic Adjuvants," *Infect Immun.* 19(2):667-675 (1978).
Krug, M. S. and Berger, S. L., "Reverse Transcriptase from Human Immunodeficiency Virus: a Single Template-primer Binding Site Serves Two Physically Separable Catalytic Functions," *Biochemistry* 30(44):10614-10623 (1991).
Lalvani A. et al., "Rapid effector Function in CD8+ Memory T Cells," *J. Exp. Med.* 186:859-865 (1997).
Lasky et al., "Delineation of a Region of the Human Immunodeficiency Virus Type 1 gp120 Glycoprotein Critical for Interaction with the CD4 Receptor," *Cell* 50(6):975-985 (1987).
Levy et al., "Isolation of Lymphocytopathic Retroviruses from San Francisco Patients with AIDS," *Science* 225:840-842 (1984).
Littman et al., "Unusual Intron in the Immunoglobulin Domain of the Newly Isolated Murine CD4 (L3T4) Gene," *Nature* 325(6103):453-455 (1987).
Looney et al., "Type-restricted Neutralization of Molecular Clones of Human Immunodeficiency Virus," *Science* 241:357-359 (1988).
Maddon et al., "The Isolation and Nucleotide Sequence of a Cdna Encoding the T Cell Surface Protein T4: a New Member of the Immunoglobulin Gene Family," *Cell* 42(1):93-104 (1985).
Maignan, S., et al. "Crystal Structures of the Catalytic Domain of HIV-1 Integrase Free and Complexed with its Metal Cofactor: High Level of Similarity of the Active Site with Other Viral Integrases," *Journal Of Molecular Biology* 282(2):359-368 (1998).
Manca et al., "Antigenicity of Hiv-derived T Helper Determinants in the Context of Carrier Recombinant Proteins: Effect on T Helper Cell Repertoire Selection," *Eur J Immunol.* 26(10):2461-2469 (1996).
Mazumder, A., et al., "Effects of nucleotide analogues on human immunodeficiency virus type 1 integrase," *Molecular Pharmacology* 49(4):621-628 (1996).
Mazza et al., "Recombinant Interleukin-2 (Ril-2) in Acquired Immune Deficiency Syndrome (Aids): Preliminary Report in Patients with Lymphoma Associated with Hiv Infection," *Eur J Haematol.* 49(1):1-6 (1992).
Mcheyzer-Williams, M.G. et al, "Enumeration and Characterization of Memory Cells in the Th Compartment," *Immunol. Rev.* 150:5-21 (1996).
McCluskie, et al., "Route and method of delivery of DNA vaccine influence immune responses in mice and non-human primates," *Mol Med.* 5(5):287-300 (1999).
McCornack et al., "HIV Protease Substrate Conformation: Modulation by Cyclophilin A, "*FEBS Letts* 414:84-88 (1997).

McMichael, A.J. and O'Callaghan, C.A., "A New Look at T Cells," *J. Exp. Med.* 187(9)1367-1371 (1998).

Modrow et al., "Computer-assisted Analysis of Envelope Protein Sequences of Seven Human Immunodeficiency Virus Isolates: Prediction of Antigenic Epitopes in Conserved and Variable Regions," *J. Virol.* 61(2):570-578 (1987).

Montagnier et al., "Human T-Cell Leukemia Viruses: The Family of Human T-Lymphotropic Retroviruses: Their Role in Malignancies and Association with AIDS," Gallo, Essex & Gross, eds., pp. 363-379 (1984).

Myers et al., "Human Retroviruses and AIDS," published by the Los Alamos National Laboratory, Los Alamos, NM, 1991, pp. I-A-48 to I-A-56 and II-77 to II-88.

Nathanson et al., "Biological Considerations in the Development of a Human Immunodeficiency Virus Vaccine," *J Infect Dis.* 182(2):579-589 (2000).

Novitsky et al., "Molecular Cloning and Phylogenetic Analysis of Human Immunodeficiency Virus Type 1 Subtype C: a Set of 23 Full-Length Clones From Botswana," *J. Virol.* 73(5):4427-4432 (1999).

Nowak and Bangham, "Population Dynamics of Immune Responses to Persistent Viruses," *Science* 272(5258):74-79 (1996).

Odile et al., "Anti-HIV Active Immunization, Evidence for Persistent Cell Mediated Immunity after a 2 Year Follow Up," Eighth International Conference on AIDS/III STD World Congress Amsterdam, The Netherlands Jul. 19-24, 1992, Abstract No. MOB 0024.

Okuda et al., "Induction of Potent Humoral and Cell-mediated Immune Responses Following Direct Injection of DNA Encoding the HIV Type 1 Env and Rev gene Products," *AIDS Res Hum Retroviruses.* 11(8):933-943 (1995).

Palaniappan, C. et al., "Mutations Within the Primer Grip Region of HIV-1 Reverse Transcriptase Result in Loss of RNase H Function," *Journal Of Biological Chemistry* 272(17):11157-11164 (1997).

Park et al., "Overexpression of The Gag-pol Precursor From Human Immunodeficiency Virus Type 1 Proviral Genomes Results in Efficient Proteolytic Processing in The Absence of Virion Production," *J. Virol.* 65:5111 (1991).

Patel et al., "Insights into DNA Polymerization Mechanisms from Structure and Function Analysis of HIV-1 Reverse Transcriptase," *Biochemistry* 34:5351-5363 (1995).

Perelson, et al., "Decay Characteristics of Hiv-1-infected Compartments During Combination Therapy," *Nature* 387(6629):188-191 (1997).

Popovic et al., "Detection, Isolation, and Continuous Production of Cytopathic Retroviruses (HTLV-III) from Patients with AIDS and Pre-AIDS," *Science* 224:497-500 (1984).

Pyle et al., "Immune Response to Immunostimulatory Complexes (ISCOMs) Prepared from Human Immunodeficiency Virus Type 1 (HIV-1) or the HIV-1 External Envelope Glycoprotein (gp120)," *Vaccine* 7(5):465-473 (1989).

Redfield and Birx, "Hiv-specific Vaccine Therapy: Concepts, Status, and Future Directions," *AIDS Res Hum Retroviruses* 8(6):1051-1058 (1992).

Reicin, A.S. et al., "Linker Insertion Mutations in the Human Immunodeficiency Virus Type 1 Gag Gene: Effects on Virion Particle Assembly, Release, and Infectivity," *J. Virol.* 69(2):642-650 (1995).

Robey, et al., "Prospect for Prevention of Human Immunodeficiency Virus Infection: Purified 120-kDa Envelope Glycoprotein Induces Neutralizing Antibody," *Proc Natl Acad Sci USA* 83(18):7023-7027 (1986).

Rodgers, D. W. et al., "The Structure of Unliganded Reverse Transcriptase from the Human Immunodeficiency Virus Type 1," *Proceedings Of the National Academy Of Sciences Of the United States Of America* 92(4):1222-1226 (1995).

Saag, et al., "Extensive Variation of Human Immunodeficiency Virus Type-1 *in vivo*,"*Nature* 334:440-444 (1988).

Saag and Kuritzkes, "Strategies for Continuing Antiretroviral Therapy," *Intl AIDS Society USA* 4(2):16-19 (1996).

Salk et al., "Prospects for the Control of Aids by Immunizing Seropositive Individuals," *Nature* 327(6122):473-476 (1987).

Schernthaner, et al., "Endosperm-specific Activity of a Zein Gene Promoter in Transgenic Tobacco Plants," *The EMBO J.* 7:1249-1259 (1988).

Schulhafer et al., "Acquired Immunodeficiency Syndrome: Molecular Biology and its Therapeutic Intervention (review)," *In Vivo* 3(2):61-78 (1989).

Sheng N. and Dennis, D., "Active Site Labeling of HIV-1 Reverse Transcriptase," *Biochemistry* 32(18):4938-4942 (1993).

Smith et al., "Blocking of HIV-1 infectivity by a soluble, secreted form of the CD4 antigen," *Science* 238(4834):1704-1707 (1987).

Spence R. A., et al., "Mechanism of Inhibition of HIV-1 Reverse Transcriptase by Nonnucleoside Inhibitors," *Science* 267(5200):988-993 (1995).

Srinivasan et al., "Molecular Characterization of Human Immunodeficiency Virus from Zaire: Nucleotide Sequence Analysis Identifies Conserved and Variable Domains in the Envelope Gene," *Gene* 52:71-82 (1987).

Starcich et al., "Identification and Characterization of Conserved and Variable Regions in the Envelope Gene of HTLV-III/LAV, the Retrovirus of AIDS," *Cell* 45:637-648 (1986).

Steimer et al., "Genetically Engineered Human Immunodeficiency Envelope Glycoprotein Gp120 Produced in Yeast Is the Target of Neutralizing Antibodies," *Vaccines* 87:236-241 (1987).

Sternberg et al., "Prediction of Antigenic Determinants and Secondary Structures of the Major Aids Virus Proteins," *FEBS Letters* 218(2):231-237 (1987).

Tindle et al., "Chimeric Hepatitis B Core Antigen Particles Containing B- and Th-epitopes of Human Papillomavirus Type 16 E7 Protein Induce Specific Antibody and T-helper Responses in Immunised Mice," *Virology* 200:547-557 (1994).

Vacca et al., "L-735,524: an Orally Bioavailable Human Immunodeficiency Virus Type 1 Protease Inhibitor," *Proc Natl Acad Sci USA* 91(9):4096-4100 (1994).

Verma et al., "Gene Therapy—Promises, Problems and Prospects," *Nature* 389(6648):239-242 (1997).

Vilmer et al., "Isolation of New Lymphotropic Retrovirus from Two Siblings with *Haemophilia B*, One with AIDS," *The Lancet* 1:753 (1984).

Wagner R., et al., "Studies on Processing, Particle Formation, and Immunogenicity of the HIV-1 gag Gene Product: a Possible Component of a HIV Vaccine," *Arch Virol.* 127:117-137 (1992).

Wagner et al., "Assembly and Extracellular Release of Chimeric HIV-1 PR55gag Retrovirus-like Particles," *Virology* 200:162-175 (1994).

Wagner et al., "Construction, Expression, and Immunogenicity of Chimeric HIV-1 Virus-like Particles," *Virology* 220:128-140 (1996).

Wakefield, J. K.et al., "*In Vitro* Enzymatic Activity of Human Immunodeficiency Virus Type 1 Reverse Transcriptase Mutants in the Highly Conserved YMDD Amino Acid Motif Correlates with the Infectious Potential of the Proviral Genome," *Journal Of Virology* 66(11):6806-6812 (1992).

Wan et al., "Autoprocessing: an Essential Step for the Activation of HIV-1 Protease," *Biochem. J.* 316:569-573 (1996).

Wang et al., "Induction of Humoral and Cellular Immune Responses to the Human Immuno-deficiency Type 1 Virus in Nonhuman Primates by in Vivo DNA Inoculation," *Virology* 211(1):102-112 (1995).

Wang C. et al., "Analysis of Minimal Human Immunodeficiency Virus Type 1 Gag Coding Sequences Capable of Virus-like Particle Assembly and Release," *J Virol* 72(10): 7950-7959 (1998).

Wu X., et al., "Targeting foreign proteins to human immunodeficiency virus particles via fusion with Vpr and Vpx," *J. Virol.* 69(6):3389-3398 (1995).

Yeni et al., "Antiretroviral and Immune-based Therapies: Update," *AIDS* 7(Suppl 1):S173-S184 (1993).

Yenofsky et al., "A Mutant Neomycin Phosphotransferase II Gene Reduces the Resistance of Transformants to Antibiotic Selection Pressure," *Proc. Natl. Acad. Sci. USA* 87:3435-3439 (1990).

Yourno et al., "Nucleotide Sequence Analysis of the Env Gene of a New Zairian Isolate of HIV-1," *AIDS Res Hum Retroviruses* 4(3):165-73 (1988).

Zagury et al., "Progress Report IV on AIDS Vaccine in Human: Phase I Clinical Trial in Hiv Infected Patients," *VII International Conference on AIDS,* Florence Jun. 16-21, 1991, Abstract No. M.A. 67.

Zagury et al., "One-year Follow-up of Vaccine Therapy in Hiv-infected Immune-deficient Individuals: a New Strategy," *J. Acquired Immune Deficiency Syndromes* 5:676-681 (1992).

Zhang Y., et al., "Analysis of the Assembly Function of the Human Immunodeficiency Virus Type 1 Gag Protein Nucleocapsid Domain," *J Virol* 72(3):1782-1789 (1998).

zur Megede et al., "Increased Expression and Immunogenicity of Sequence-modified Human Immunodeficiency Virus Type 1 Gag Gene," *J Virol.* 74(6):2628-2635 (2000).

Andre, et al., "Increased Immune Response Elicited by DNA Vaccination with a Synthetic GP120 Sequence With Optimized Codon Usage," J. of Virology, 72(2): 1497-1503 (1998).

Haas et al., "Cytotoxin T-Cell Responses to HIV-1 Reverse Transcriptase, Integrase and Protease," AIDS, 12:1427-1436 (1998).

Hamajima, et al., "The Combination of DNA and Peptide Vaccines Induces Strong Immunities Against HIV-1 in Both Humoral and CM1," 11th International AIDS Conference, Vancouver, Britich Colombia, Jul. 7-12; 11:6 (abstract No. Mo.A.151) (1996).

Kent, et al., "A Recombinant Avipoxvirus HIV-1 Vaccine Expressing Interferon-Gamma is Safe and Immunogenic in Macaques," Vaccine 18:2250-2256 (2000).

Williamson, et al., "Designing HIV-1 Subtype C Vaccine for South Africa," South African Journal of Science, 96:318-324 (2000).

Chapman, et al., "Effect of Intron A From Human Cytomegalovirus (Towne) Immediate-Early Gene on Heterologous Expression in Mammalian Cells," Nucleic Acids Research, 19:3979-3986 (1991).

* cited by examiner

8_5_ZA

```
   1 TGGAAGGGTT AATTTACTCC AAGAAAAGGC AAGAAATCCT TGATTTGTGG GTCTATCACA
  61 CACAAGGCTT CTTCCCTGAT TGGCAAAACT ACACACCGGG CCAGGGGTC AGATATCCAC
 121 TGACCTTTGG ATGGTGCTAC AAGCTAGTGC CAGTTGACCC AGGGGAGGTG GAAGAGGCCA
 181 ACGGAGGAGA AGACAACTGT TTGCTACACC CTATGAGCCA ACATGGAGCA GAGGATGAAG
 241 ATAGAGAAGT ATTAAAGTGG AAGTTTGACA GCCTCCTAGC ACGCAGACAC ATGGCCCGCG
 301 AGCTACATCC GGAGTATTAC AAAGACTGCT GACACAGAAG GGACTTTCCG CCTGGGACTT
 361 TCCACTGGGG CGTTCCGGGA GGTGTGGTCT GGGCGGGACT TGGGAGTGGT CAACCCTCAG
 421 ATGCTGCATA TAAGCAGCTG CTTTTCGCCT GTACTGGGTC TCTCTCGGTA GACCAGATCT
 481 GAGCCTGGGA GCCCTCTGGC TATCTAGGGA ACCCACTGCT TAAGCCTCAA TAAAGCTTGC
 541 CTTGAGTGCT TTAAGTAGTG TGTGCCCATC TGTTGTGTGA CTCTGGTAAC TAGAGATCCC
 601 TCAGACCCTT TGTGGTAGTG TGGAAAATCT CTAGCAGTGG CGCCCGAACA GGGACCAGAA
 661 AGTGAAAGTG AGACCAGAGG AGATCTCTCG ACGCAGGACT CGGCTTGCTG AAGTGCACAC
 721 GGCAAGAGGC GAGAGGGGCG GCTGGTGAGT ACGCCAATTT TACTTGACTA GCGGAGGCTA
 781 GAAGGAGAGA GATGGGTGCG AGAGCGTCAA TATTAAGCGG CGGAAAATTA GATAAATGGG
 841 AAAGAATTAG GTTAAGGCCA GGGGGAAAGA AACATTATAT GTTAAAACAT CTAGTATGGG
 901 CAAGCAGGGA GCTGGAAAGA TTTGCACTTA ACCCTGGCCT GTTAGAAACA TCAGAAGGCT
 961 GTAAACAAAT AATAAAACAG CTACAACCAG CTCTTCAGAC AGGAACAGAG GAACTTAGAT
1021 CATTATTCAA CACAGTAGCA ACTCTCTATT GTGTACATAA AGGGATAGAG GTACGAGACA
1081 CCAAGGAAGC CTTAGACAAG ATAGAGGAAG AACAAAACAA ATGTCAGCAA AAAGCACAAC
1141 AGGCAAAAGC AGCTGACGAA AAGGTCAGTC AAAATTATCC TATAGTACAG AATGCCCAAG
1201 GGCAAATGGT ACACCAAGCT ATATCACCTA GAACATTGAA TGCATGGATA AAAGTAATAG
1261 AGGAAAAGGC TTTCAATCCA GAGGAAATAC CCATGTTTAC AGCATTATCA GAAGGAGCCA
1321 CCCCACAAGA TTTAAACACA ATGTTAAATA CAGTGGGGGG ACATCAAGCA GCCATGCAAA
1381 TGTTAAAAGA TACCATCAAT GAGGAGGCTG CAGAATGGGA TAGGACACAT CCAGTACATG
1441 CAGGGCCTGT TGCACCAGGC CAGATGAGAG AACCAAGGGG AAGTGACATA GCAGGAACTA
1501 CTAGTACCCT TCAGGAACAA ATAGCATGGA TGACAAGTAA TCCACCTATT CCAGTAGAAG
1561 ACATCTATAA AAGATGGATA ATTCTGGGGT TAAATAAAAT AGTAAGAATG TATAGCCCTG
1621 TTAGCATTTT GGACATAAAA CAAGGGCCAA AGAACCCTT TAGAGACTAT GTAGACCGGT
1681 TCTTTAAAAC CTTAAGAGCT GAACAAGCTA CACAAGATGT AAAGAATTGG ATGACAGACA
1741 CCTTGTTGGT CCAAAATGCG AACCCAGATT GTAAGACCAT TTTAAGAGCA TTAGGACCAG
1801 GGCCTCATT AGAAGAAATG ATGACAGCAT GTCAGGGAGT GGGAGGACCT AGCCATAAAG
1861 CAAGAGTGTT GGCTGAGGCA ATGAGCCAAG CAAACAGTAA CATACTAGTG CAGAGAAGCA
1921 ATTTTAAAGG CTCTAACAGA ATTATTAAAT GTTTCAACTG TGGCAAAGTA GGGCACATAG
1981 CCAGAAATTG CAGGGCCCCT AGGAAAAAGG GCTGTTGGAA ATGTGGACAG GAAGGACACC
2041 AAATGAAAGA CTGTACTGAG AGGCAGGCTA ATTTTTTAGG GAAAATTTGG CCTTCCCACA
2101 AGGGGAGGCC AGGGAATTTC CTCCAGAACA GACCAGAGCC AACAGCCCCA CCAGCAGAAC
2161 CAACAGCCCC ACCAGCAGAG AGCTTCAGGT TCGAGGAGAC AACCCCCGTG CCGAGGAAGG
2221 AGAAAGAGAG GGAACCTTTA ACTTCCCTCA AATCACTCTT TGGCAGCGAC CCCTTGTCTC
2281 AATAAAAGTA GAGGGCCAGA TAAAGGAGGC TCTCTTAGAC ACAGGAGCAG ATGATACAGT
2341 ATTAGAAGAA ATAGATTTGC CAGGGAAATG GAAACCAAAA ATGATAGGGG GAATTGGAGG
2401 TTTTATCAAA GTAAGACAGT ATGATCAAAT ACTTATAGAA ATTTGTGGAA AAAAGGCTAT
2461 AGGTACAGTA TTAGTAGGGC CTACACCAGT CAACATAATT GGAAGAAATC TGTTAACTCA
2521 GCTTGGATGC ACACTAAATT TTCCAATTAG TCCTATTGAA ACTGTACCAG TAAAATTAAA
2581 ACCAGGAATG GATGGCCCAA AGGTCAAACA ATGGCCATTG ACAGAAGAAA AAATAAAAGC
2641 ATTAACAGCA ATTTGTGAGG AAATGGAGAA GGAAGGAAAA ATTACAAAAA TTGGGCCTGA
2701 TAATCCATAT AACACTCCAG TATTTGCCAT AAAAAAGAAG GACAGTACTA AGTGGAGAAA
2761 ATTAGTAGAT TTCAGGGAAC TCAATAAAAG AACTCAAGAC TTTTGGGAAG TTCAATTAGG
2821 AATACCACAC CCAGCAGGAT TAAAAAAGAA AAAATCAGTG ACAGTGCTAG ATGTGGGGGA
```

Figure 1A

```
2881 TGCATATTTT TCAGTTCCTT TAGATGAAAG CTTCAGGAAA TATACTGCAT TCACCATACC
2941 TAGTATAAAC AATGAAACAC CAGGGATTAG ATATCAATAT AATGTGCTGC CACAGGGATG
3001 GAAAGGATCA CCAGCAATAT TCCAGAGTAG CATGACAAAA ATCTTAGAGC CCTTCAGAGC
3061 AAAAAATCCA GACATAGTTA TCTATCAATA TATGGATGAC TTGTATGTAG GATCTGACTT
3121 AGAAATAGGG CAACATAGAG CAAAAATAGA AGAGTTAAGG GAACATTTAT TGAAATGGGG
3181 ATTTACAACA CCAGACAAGA AACATCAAAA AGAACCCCCA TTTCTTTGGA TGGGGTATGA
3241 ACTCCATCCT GACAAATGGA CAGTACAACC TATACTGCTG CCAGAAAAGG ATAGTTGGAC
3301 TGTCAATGAT ATACAGAAGT TAGTGGGAAA ATTAAACTGG GCAAGTCAGA TTTACCCAGG
3361 GATTAAAGTA AGGCAACTCT GTAAACTCCT CAGGGGGGCC AAAGCACTAA CAGACATAGT
3421 ACCACTAACT GAAGAAGCAG AATTAGAATT GGCAGAGAAC AGGGAAATTT AAGAGAACC
3481 AGTACATGGA GTATATTATG ATCCATCAAA AGACTTGATA GCTGAAATAC AGAAACAGGG
3541 GCATGAACAA TGGACATATC AAATTTATCA AGAACCATTT AAAAATCTGA AAACAGGGAA
3601 GTATGCAAAA ATGAGGACTA CCCACACTAA TGATGTAAAA CAGTTAACAG AGGCAGTGCA
3661 AAAAATAGCC ATGGAAAGCA TAGTAATATG GGAAAGACT CCTAAATTTA GACTACCCAT
3721 CCAAAAAGAA ACATGGGAGA CATGGTGGAC AGACTATTGG CAAGCCACCT GGATCCCTGA
3781 GTGGGAGTTT GTTAATACCC CTCCCCTAGT AAAATTATGG TACCAACTAG AAAAAGATCC
3841 CATAGCAGGA GTAGAAACTT TCTATGTAGA TGGAGCAACT AATAGGGAAG CTAAAATAGG
3901 AAAAGCAGGG TATGTTACTG ACAGAGGAAG GCAGAAAATT GTTACTCTAA CTAACACAAC
3961 AAATCAGAAG ACTGAGTTAC AAGCAATTCA GCTAGCTCTG CAGGATTCAG GATCAGAAGT
4021 AAACATAGTA ACAGACTCAC AGTATGCATT AGGAATCATT CAAGCACAAC CAGATAAGAG
4081 TGACTCAGAG ATATTTAACC AAATAATAGA ACAGTTAATA AACAAGGAAA GAATCTACCT
4141 GTCATGGGTA CCAGCACATA AAGGAATTGG GGGAAATGAA CAAGTAGATA AATTAGTAAG
4201 TAAGGGAATT AGGAAAGTGT TGTTTCTAGA TGGAATAGAT AAAGCTCAAG AAGAGCATGA
4261 AAGGTACCAC AGCAATTGGA GAGCAATGGC TAATGAGTTT AATCTGCCAC CCATAGTAGC
4321 AAAAGAAATA GTAGCTAGCT GTGATAAATG TCAGCTAAAA GGGGAAGCCA TACATGGACA
4381 AGTCGACTGT AGTCCAGGGA TATGGCAATT AGATTGTACC CATTTAGAGG GAAAAATCAT
4441 CCTGGTAGCA GTCCATGTAG CTAGTGGCTA CATGGAAGCA GAGGTTATCC CAGCAGAAAC
4501 AGGACAAGAA ACAGCATATT TTATATTAAA ATTAGCAGGA AGATGGCCAG TCAAAGTAAT
4561 ACATACAGAC AATGGCAGTA ATTTTACCAG TACTGCAGTT AAGGCAGCCT GTTGGTGGGC
4621 AGGTATCCAA CAGGAATTTG GAATTCCCTA CAATCCCCAA AGTCAGGGAG TGGTAGAATC
4681 CATGAATAAA GAATTAAAGA AAATAATAGG ACAAGTAAGA GATCAAGCTG AGCACCTTAA
4741 GACAGCAGTA CAAATGGCAG TATTCATTCA CAATTTTAAA AGAAAGGGGG GAATTGGGGG
4801 GTACAGTGCA GGGGAAAGAA TAATAGACAT AATAGCAACA GACATACAAA CTAAAGAATT
4861 ACAAAAACAA ATTATAAGAA TTCAAAATTT TCGGGTTTAT TACAGAGACA GCAGAGACCC
4921 TATTTGGAAA GGACCAGCCG AACTACTCTG GAAAGGTGAA GGGGTAGTAG TAATAGAAGA
4981 TAAAGGTGAC ATAAGGTAG TACCAAGGAG GAAAGCAAAA ATCATTAGAG ATTATGGAAA
5041 ACAGATGGCA GGTGCTGATT GTGTGGCAGG TGGACAGGAT GAAGATTAGA GCATGGAATA
5101 GTTTAGTAAA GCACCATATG TATATATCAA GGAGAGCTAG TGGATGGGTC TACAGACATC
5161 ATTTTGAAAG CAGACATCCA AAAGTAAGTT CAGAAGTACA TATCCCATTA GGGGATGCTA
5221 GATTAGTAAT AAAAACATAT TGGGGTTTGC AGACAGGAGA AAGAGATTGG CATTTGGGTC
5281 ATGGAGTCTC CATAGAATGG AGACTGAGAG AATACAGCAC ACAAGTAGAC CCTGACCTGG
5341 CAGACCAGCT AATTCACATG CATTATTTTG ATTGTTTAC AGAATCTGCC ATAAGACAAG
5401 CCATATTAGG ACACATAGTT TTTCCTAGGT GTGACTATCA AGCAGGACAT AAGAAGGTAG
5461 GATCTCTGCA ATACTTGGCA CTGACAGCAT TGATAAAACC AAAAAAGAGA AAGCCACCTC
5521 TGCCTAGTGT TAGAAAATTA GTAGAGGATA GATGGAACGA CCCCCAGAAG ACCAGGGGCC
5581 GCAGAGGGAA CCATACAATG AATGGACACT AGAGATTCTA GAAGAACTCA AGCAGGAAGC
5641 TGTCAGACAC TTTCCTAGAC CATGGCTCCA TAGCTTAGGA CAATATATCT ATGAAACCTA
5701 TGGGGATACT TGGACGGGAG TTGAAGCTAT AATAAGAGTA CTGCAACAAC TACTGTTCAT
5761 TCATTTCAGA ATTGGATGCC AACATAGCAG AATAGGCATC TTGCGACAGA GAAGAGCAAG
```

Figure 1B

```
5821 AAATGGAGCC AGTAGATCCT AAACTAAAGC CCTGGAACCA TCCAGGAAGC CAACCTAAAA
5881 CAGCTTGTAA TAATTGCTTT TGCAAACACT GTAGCTATCA TTGTCTAGTT TGCTTTCAGA
5941 CAAAAGGTTT AGGCATTTCC TATGGCAGGA AGAAGCGGAG ACAGCGACGA AGCGCTCCTC
6001 CAAGTGGTGA AGATCATCAA AATCCTCTAT CAAAGCAGTA AGTACACATA GTAGATGTAA
6061 TGGTAAGTTT AAGTTTATTT AAAGGAGTAG ATTATAGATT AGGAGTAGGA GCATTGATAG
6121 TAGCACTAAT CATAGCAATA ATAGTGTGGA CCATAGCATA TATAGAATAT AGGAAATTGG
6181 TAAGACAAAA GAAAATAGAC TGGTTAATTA AAAGAATTAG GGAAAGAGCA GAAGACAGTG
6241 GCAATGAGAG TGATGGGGAC ACAGAAGAAT TGTCAACAAT GGTGGATATG GGGCATCTTA
6301 GGCTTCTGGA TGCTAATGAT TTGTAACACG GAGGACTTGT GGGTCACAGT CTACTATGGG
6361 GTACCTGTGT GGAGAGAAGC AAAAACTACT CTATTCTGTG CATCAGATGC TAAAGCATAT
6421 GAGACAGAAG TGCATAATGT CTGGGCTACA CATGCTTGTG TACCCACAGA CCCCAACCCA
6481 CAAGAAATAG TTTTGGGAAA TGTAACAGAA AATTTAATA TGTGGAAAAA TAACATGGCA
6541 GATCAGATGC ATGAGGATAT AATCAGTTTA TGGGATCAAA GCCTAAAGCC ATGTGTAAAG
6601 TTGACCCCAC TCTGTGTCAC TTTAAACTGT ACAGATACAA ATGTTACAGG TAATAGAACT
6661 GTTACAGGTA ATACAAATGA TACCAATATT GCAAATGCTA CATATAAGTA TGAAGAAATG
6721 AAAAATTGCT CTTTCAATGC AACCACAGAA TTAAGAGATA AGAAACATAA AGAGTATGCA
6781 CTCTTTTATA AACTTGATAT AGTACCACTT AATGAAAATA GTAACAACTT ACATATAGA
6841 TTAATAAATT GCAATACCTC AACCATAACA CAAGCCTGTC CAAAGGTCTC TTTTGACCCG
6901 ATTCCTATAC ATTACTGTGC TCCAGCTGAT TATGCGATTC TAAAGTGTAA TAATAAGACA
6961 TTCAATGGGA CAGGACCATG TTATAATGTC AGCACAGTAC AATGTACACA TGGAATTAAG
7021 CCAGTGGTAT CAACTCAACT ACTGTTAAAT GGTAGTCTAG CAGAAGAAGG GATAATAATT
7081 AGATCTGAAA ATTTGACAGA GAATACCAAA ACAATAATAG TACATCTTAA TGAATCTGTA
7141 GAGATTAATT GTACAAGGCC CAACAATAAT ACAAGGAAAA GTGTAAGGAT AGGACCAGGA
7201 CAAGCATTCT ATGCAACAAA TGACGTAATA GGAAACATAA GACAAGCACA TTGTAACATT
7261 AGTACAGATA GATGGAATAA AACTTTACAA CAGGTAATGA AAAAATTAGG AGAGCATTTC
7321 CCTAATAAAA CAATAAAATT TGAACCACAT GCAGGAGGGG ATCTAGAAAT TACAATGCAT
7381 AGCTTTAATT GTAGAGGAGA ATTTTTCTAT TGCAATACAT CAAACCTGTT TAATAGTACA
7441 TACTACCCTA AGAATGGTAC ATACAAATAC AATGGTAATT CAAGCTTACC CATCACACTC
7501 CAATGCAAAA TAAAACAAAT TGTACGCATG TGGCAAGGGG TAGGACAAGC AATGTATGCC
7561 CCTCCCATTG CAGGAAACAT AACATGTAGA TCAAACATCA CAGGAATACT ATTGACACGT
7621 GATGGGGGAT TTAACAACAC AAACAACGAC ACAGAGGAGA CATTCAGACC TGGAGGAGGA
7681 GATATGAGGG ATAACTGGAG AAGTGAATTA TATAAATATA AGTGGTAGA AATTAAGCCA
7741 TTGGGAATAG CACCCACTAA GGCAAAAAGA AGAGTGGTGC AGAGAAAAAA AAGAGCAGTG
7801 GGAATAGGAG CTGTGTTCCT TGGGTTCTTG GGAGCAGCAG GAAGCACTAT GGGCGCAGCG
7861 TCAATAACGC TGACGGTACA GGCCAGACAA CTGTTGTCTG GTATAGTGCA ACAGCAAAGC
7921 AATTTGCTGA AGGCTATAGA GGCGCAACAG CATATGTTGC AACTCACAGT CTGGGGCATT
7981 AAGCAGCTCC AGGCGAGAGT CCTGGCTATA GAAAGATACC TAAAGGATCA ACAGCTCCTA
8041 GGGATTTGGG GCTGCTCTGG AAGACTCATC TGCACCACTG CTGTGCCTTG GAACTCCAGT
8101 TGGAGTAATA AATCTGAAGC AGATATTTGG GATAACATGA CTTGGATGCA GTGGGATAGA
8161 GAAATTAATA ATTACACAGA AACAATATTC AGGTTGCTTG AAGACTCGCA AAACCAGCAG
8221 GAAAAGAATG AAAAAGATTT ATTAGAATTG GACAAGTGGA ATAATCTGTG GAATTGGTTT
8281 GACATATCAA ACTGGCTGTG GTATATAAAA ATATTCATAA TGATAGTAGG AGGCTTGATA
8341 GGTTTAAGAA TAATTTTTGC TGTGCTCTCT ATAGTGAATA GAGTTAGGCA GGGATACTCA
8401 CCTTTGTCAT TTCAGACCCT TACCCCAAGC CCGAGGGGAC TCGACAGGCT CGGAGGAATC
8461 GAAGAAGAAG GTGGAGAGCA AGACAGAGAC AGATCCATAC GATTGGTGAG CGGATTCTTG
8521 TCGCTTGCCT GGGACGATCT GCGGAGCCTG TGCCTCTTCA GCTACCACCG CTTGAGAGAC
8581 TTCATATTAA TTGCAGTGAG GCAGTGGAA CTTCTGGGAC ACAGCAGTCT CAGGGGACTA
8641 CAGAGGGGGT GGGAGATCCT TAAGTATCTG GAAGTCTTG TGCAGTATTG GGGTCTAGAG
8701 CTAAAAAAGA GTGCTATTAG TCCGCTTGAT ACCATAGCAA TAGCAGTAGC TGAAGGAACA
8761 GATAGGATTA TAGAATTGGT ACAAGAATT TGTAGAGCTA TCCTCAACAT ACCTAGGAGA
```

Figure 1C

```
8821 ATAAGACAGG GCTTTGAAGC AGCTTTGCTA TAAAATGGGA GGCAAGTGGT CAAAACGCAG
8881 CATAGTTGGA TGGCCTGCAG TAAGAGAAAG AATGAGAAGA ACTGAGCCAG CAGCAGAGGG
8941 AGTAGGAGCA GCGTCTCAAG ACTTAGATAG ACATGGGGCA CTTACAAGCA GCAACACACC
9001 TGCTACTAAT GAAGCTTGTG CCTGGCTGCA AGCACAAGAG GAGGACGGAG ATGTAGGCTT
9061 TCCAGTCAGA CCTCAGGTAC CTTTAAGACC AATGACTTAT AAGAGTGCAG TAGATCTCAG
9121 CTTCTTTTTA AAAGAAAAGG GGGGACTGGA AGGGTTAATT TACTCTAGGA AAAGGCAAGA
9181 AATCCTTGAT TTGTGGGTCT ATAACACACA AGGCTTCTTC CCTGATTGGC AAAACTACAC
9241 ATCGGGGCCA GGGGTCCGAT TCCCACTGAC CTTTGGATGG TGCTTCAAGC TAGTACCAGT
9301 TGACCCAAGG GAGGTGAAAG AGGCCAATGA AGGAGAAGAC AACTGTTTGC TACACCCTAT
9361 GAGCCAACAT GGAGCAGAGG ATGAAGATAG AGAAGTATTA AAGTGGAAGT TTGACAGCCT
9421 TCTAGCACAC AGACACATGG CCCGCGAGCT ACATCCGGAG TATTACAAAG ACTGCTGACA
9481 CAGAAGGGAC TTTCCGCCTG GGACTTTCCA CTGGGGCGTT CCGGGAGGTG TGGTCTGGGC
9541 GGGACTTGGG AGTGGTCACC CTCAGATGCT GCATATAAGC AGCTGCTTTT CGCTTGTACT
9601 GGGTCTCTCT CGGTAGACCA GATCTGAGCC TGGGAGCTCT CTGGCTATCT AGGGAACCCA
9661 CTGCTTAGGC CTCAATAAAG CTTGCCTTGA GTGCTCTAAG TAGTGTGTGC CCATCTGTTG
9721 TGTGACTCTG GTAACTAGAG ATCCCTCAGA CCCTTTGTGG TAGTGTGGAA AATCTCTAGC
9781 A
```

↓ : is the regions for β-sheet deletions

*: is the N-linked glycosylation sites for subtype C TV1 and TV2. Possible mutation (N→ Q) or deletions can be performed.

```
                        1                                                  50
       SF162      (1)   ----MDAMKRGLCC LL C AVF SPSA EK              W E T
       TV1.8_2    (1)   MRVMGTQKNCQQWWIWGIL FWMLMICNTED              WR  K
       TV1.8_5    (1)   MRVMGTQKNCQQWWIWGIL FWMLMICNTED              WRE K
       TV2.12-5/1 (1)   MRARGILKNYRHWWIWGIL FWMLM CN KG              GRE K
       Consensus  (1)   MRVMGTQKNCQQWWIWGILGFWMLMICNVEDLWVTVYYGVPVWREAKTTL 51                                        *       100
       SF162      (47)           T         V         IV E
       TV1.8_2    (51)         ET         V         IV G            ND AD
       TV1.8_5    (51)         ET         V         IV G            NN AD
       TV2.12-5/1 (51)         EK         V         G              D  D
       Consensus  (51)  FCASDAKAYETEVHNVWATHACVPTDPNPQEIVLGNVTENFNMWKNNMVD β2/V1V2/β3
                        101         ↓           *   *   *      *   *  150
       SF162      (97)    H  I              H    LKNAT TK-----S N---
       TV1.8_2    (101)   H  V              N    DTNVTG RTVTGN TNNTN
       TV1.8_5    (101)   H  I              N    DTNVTG RTVTGN NDTNI
       TV2.12-5/1 (101)   Q  I              N    ATVNY -------N S---
       Consensus  (101) QMHEDIISLWDQSLKPCVKLTPLCVTLNCTNTVTGNRTVTGNSNSN  A 151  *   *                                      *200
       SF162      (139) WKEMDRGE       KV  S  N MQ  Y     W   DN----DNT
       TV1.8_2    (151) T IYNIEEM   NA   EL D KH  Y      I   LN--ENSDNFT
       TV1.8_5    (151) N TYKYEEM   NA   EL D KH  Y      I   LN--ENS NFT
       TV2.12-5/1 (141) ------K M   Y   EL D KK  N    R  I   LNNRKNG INN
       Consensus  (151)   A Y   EEMKNCSFNVTTELRDKKHKEYALFYKLDIVPLNN ENSNNFTY

*
                        201  *   ↓                              *   *  250
       SF162      (185)           V                      G  I   D K   S   T
       TV1.8_2    (199) R         T         D            GY I   N   T  Y
       TV1.8_5    (199) R         T         D            DY I   N   T  Y
       TV2.12-5/1 (185) R         A         D            GY P   N K  I  D
       Consensus  (201) RLINCNTSTITQACPKVSFDPIPIHYCAPAGYAILKCNNKTFNGTGPCYN 251           *                *             300
       SF162      (235)                          G  S  F D A    Q K
       TV1.8_2    (249)           K              GII     L E T   H N
       TV1.8_5    (249)           K              GII     L E T   H N
       TV2.12-5/1 (235)           K              EII     L N V   H N
       Consensus  (251) VSTVQCTHGIKPVVSTQLLLNGSLAEEGIIIRSENLTENTKTIIVHLNES

*
                        301*    *                              *    *350
       SF162      (285) V  N    N      T   R    G   D       G   N
       TV1.8_2    (299) V  N    N      VR   Q             TDR  K
       TV1.8_5    (299) V  N    N      VR   Q             TDR  K
       TV2.12-5/1 (285)    K    G      VR      G   D      KNE  T
       Consensus  (301) VEINCTRPNNNTRKSVRIGPGQAFYATNDIIGNIRQAHCNISTDRWNKTL
```

Figure 2B

```
                351                    *                              *      400
    SF162  (335) KQ  T   AQ  G K  - V KQS        P   VM                         
   TV1.8_2 (349) QQVMK  GEH P K -  Q KPH       L  TM                      T N   
   TV1.8_5 (349) QQVMK  GEH P K - K EPH        L  TM                      T N   
 TV2.12-5/1 (335) QRVSQ   EL P S G K APH       L  TT              G       T D   
  Consensus (351) QQVMKKLQEHFPNKT IKFKPHAGGDLEITMHSFNCRGEFFYCNTSNLFN 401          *              *        ↓  β20/β21  ↓    450
    SF162  (384)    NN------ IGP  -N NGT   P        NR  E   KM      R 
   TV1.8_2 (398)    Y S---NNG YKY GNSSSP   Q        VM       Q T      A 
   TV1.8_5 (398)    Y P---KNG YKY GNSSLP   Q        VM       Q M      A 
 TV2.12-5/1 (385)   YSNGTCTNG CMS --N ER   Q        NM   E   RM       A 
  Consensus (401) STYHN    NGTYKYNGNSS PITLQCKIKQIIRMWQGVGQAMYAPPIAG

*
                451        *             *   *                        500
    SF162  (427)   R S              KEI N --T I                        
   TV1.8_2 (445) N T R              FNTTNN--T T                        
   TV1.8_5 (445) N T R              FNNTNNDTE T                        
 TV2.12-5/1 (433) N T R              DNNTE ---  T                      
  Consensus (451) NITCRSNITGILLTRDGGFNNTNT    TETFRPGGGDMRDNWRSELYKYKV 501                                              550
    SF162  (475)  K E       K    Q EK  T  M              G   R 
   TV1.8_2 (493)  E K       K    Q EK  GI  V             A  I  
   TV1.8_5 (495)  E K       K    Q EK  GI  V             A  I  
 TV2.12-5/1 (480)  E K      A  K   E EK  GI  V             A  I  
  Consensus (501) VEIKPLGIAPTKAKRRVVQREKRAVGIGAVFLGFLGAAGSTMGAASITLT 551                                              600
    SF162  (525)                    N                                K
   TV1.8_2 (543)                    S                          I    K
   TV1.8_5 (545)                    S                    M     I    K
 TV2.12-5/1 (530)                    S                    M     I    Q
  Consensus (551) VQARQLLSGIVQQQSNLLKAIEAQQHMLQLTWGIKQLQARVLAIERYLK

*
                601                      *     *     *              650
    SF162  (575)     I         A P  A W   SLDQ  N   W   E    D  
   TV1.8_2 (593)     I         A P S   N SEKD  D   W  Q D    S  
   TV1.8_5 (595)     I         A P S   N SE D  D   W  Q D    N  
 TV2.12-5/1 (580)              N L  S   N Q D  D   W  Q D    S  
  Consensus (601) DQQLLGIWGCSGKLICTTAVPWNSSWSNKSEADIWDNMTWMQWDREISNY 651                                              700
    SF162  (625)  NL YT      N  K N Q  E  K AS     D SK L        
   TV1.8_2 (643)  GL YN L D  N  K KD  E   K NN     D SN P        
   TV1.8_5 (645)  E   R L D  N  K KD E   K NN      D SN L        
 TV2.12-5/1 (630)  N  YR L D  S    KD  A   NN     S  N L        
  Consensus (651) TNTIYRLLEDSQNQQEKNEKDLLELDKWNNLWNWFDISNWLWYIKIFIMI 701                                              750
    SF162  (675)              T  I      I        F  RF        PE     
   TV1.8_2 (693)     I   I A  I         I        F  LT S   L  LG     
   TV1.8_5 (695)     I   I A  I         I        F  LT S   L  LG     
 TV2.12-5/1 (680)    I   I A  I                 L  LI N       LG     
  Consensus (701) VGGLIGLRIIFAVLSIVNRVRQGYSPLSFQTLTPSPRGPDRLGGIEEEGG
```

Figure 2C

```
                        751                                           800
     SF162    (725)  ▓R▓RD▓▓SP▓▓H▓L▓▓▓I▓▓▓▓▓S▓▓▓▓S▓▓▓▓▓▓L▓▓AA▓I▓▓▓▓R-
     TV1.8_2  (743)  ▓Q▓RD▓▓IR▓▓S▓F▓S▓A▓▓▓▓▓N▓▓▓S▓▓▓▓▓▓F▓▓AV▓A▓▓▓▓HS
     TV1.8_5  (745)  ▓Q▓RD▓▓IR▓▓S▓F▓S▓A▓▓▓▓▓S▓▓▓S▓▓▓▓▓▓F▓▓AV▓A▓▓▓▓HS
  TV2.12-5/1  (730)  ▓Q▓SS▓▓IR▓▓S▓F▓▓▓A▓▓▓▓▓S▓▓▓C▓▓▓▓▓▓F▓▓VV▓A▓▓▓▓HS
  Consensus   (751)  EQDRDRSIRLVSGFLSLAWDDLRSLCLFSYHRLRDFILIAVRAVELLGHS
                        801                                          850
     SF162    (774)  ------▓▓WEA▓▓W▓N▓▓▓▓IQ▓▓▓N▓▓▓SLF▓A▓▓▓A▓▓▓▓▓▓I▓
     TV1.8_2  (793)  SLRGLQ▓▓▓EI▓▓L▓S▓V▓▓WGL▓▓▓K▓▓ISLL▓T▓▓▓T▓▓▓▓▓▓I▓
     TV1.8_5  (795)  SLRGLQ▓▓▓EI▓▓L▓S▓V▓▓GL▓▓▓K▓▓ISPL▓T▓▓A▓▓▓▓▓▓▓I▓
  TV2.12-5/1  (780)  SLRGLQ▓▓▓GT▓▓L▓S▓V▓▓GL▓▓▓K▓▓INLL▓T▓▓A▓▓▓▓▓▓▓▓▓
  Consensus   (801)  SLRGLQRGWEILKYLGSLVQYWGLELKKSAISLLDTIAIAVAEGTDRIIE
                        851                876
     SF162    (818)  ▓A▓RIG▓AFLHI▓▓▓▓▓▓▓▓R▓▓L-
     TV1.8_2  (843)  LV▓RIC▓AILNI▓▓▓▓▓▓▓▓A▓▓L-
     TV1.8_5  (845)  LV▓RIC▓AILNI▓▓▓▓▓▓▓▓A▓▓L-
  TV2.12-5/1  (830)  F▓▓N▓C▓▓IRN▓▓▓▓▓▓▓▓A▓▓Q-
  Consensus   (851)  LVQRICRAILNIPRRIRQGFEAALL
```

1. Mock
2. LTR-Cat only
3. SV40-Tat
4. TatWT 2A
5. Tatopt 2A
6. TatC22 2A
7. TatC22C37 2A
8. TatC37 2A
9. TatC22 SF162
10. TatC22C37 SF162
11. TatC37 SF162
12. TatC22PRTrevnef
13. PRTtatC22revnef

Figure 6A

GagComplPolmut_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAAGAATTCGCCGAGGCCATGAGCCAGGCCACCAGCGCC
AACATCCTGATGCAGCGCAGCAACTTCAAGGGCCCCAAGCGCATCATCAAGTGCTTCAACTGCGGCAAG
GAGGGCCACATCGCCCGCAACTGCCGCGCCCCCCGCAAGAAGGGCTGCTGGAAGTGCGGCAAGGAGGGC
CACCAGATGAAGGACTGCACCGAGCGCCAGGCCAACTTCTTCCGCGAGGACCTGGCCTTCCCCCAGGGC
AAGGCCCGCGAGTTCCCCAGCGAGCAGAACCGCGCCAACAGCCCCACCAGCCGCGAGCTGCAGGTGCGC
GGCGACAACCCCGCAGCGAGGCCGGCGCCGAGCGCCAGGGCACCCTGAACTTCCCCCAGATCACCCTG
TGGCAGCGCCCCCTGGTGAGCATCAAGGTGGGCGGCCAGATCAAGGAGGCCCTGCTGGACACCGGCGCC
GACGACACCGTGCTGGAGGAGATGAGCCTGCCCGGCAAGTGGAAGCCCAAGATGATCGGCGGCATCGGC
GGCTTCATCAAGGTGCGCCAGTACGACCAGATCCTGATCGAGATCTGCGGCAAGAAGGCCATCGGCACC
GTGCTGATCGGCCCCACCCCCGTGAACATCATCGGCCGCAACATGCTGACCCAGCTGGGCTGCACCCTG
AACTTCCCCATCAGCCCCATCGAGACCGTGCCCGTGAAGCTGAAGCCCGGCATGGACGGCCCCAAGGTG
AAGCAGTGGCCCCTGACCGAGGAGAAGATCAAGGCCCTGACCGCCATCTGCGAGGAGATGGAGAAGGAG
GGCAAGATCACCAAGATCGGCCCCGAGAACCCCTACAACACCCCCGTGTTCGCCATCAAGAAGAAGGAC
AGCACCAAGTGGCGCAAGCTGGTGGACTTCCGCGAGCTGAACAAGCGCACCCAGGACTTCTGGGAGGTG
CAGCTGGGCATCCCCCACCCCGCCGGCCTGAAGAAGAAGAAGAGCGTGACCGTGCTGGACGTGGGCGAC
GCCTACTTCAGCGTGCCCCTGGACGAGGACTTCCGCAAGTACACCGCCTTCACCATCCCCAGCATCAAC
AACGAGACCCCCGGCATCCGCTACCAGTACAACGTGCTGCCCCAGGGCTGGAAGGGCAGCCCCAGCATC
TTCCAGAGCAGCATGACCAAGATCCTGGAGCCCTTCCGCGCCCGCAACCCCGAGATCGTGATCTACCAG
GCCCCCCTGTACGTGGGCAGCGACCTGGAGATCGGCCAGCACCGCGCCAAGATCGAGGAGCTGCGCAAG
CACCTGCTGCGCTGGGGCTTCACCACCCCCGACAAGAAGCACCAGAAGGAGCCCCCCTTCCTGCCCATC
GAGCTGCACCCCGACAAGTGGACCGTGCAGCCCATCGAGCTGCCCGAGAAGGAGAGCTGGACCGTGAAC
GACATCCAGAAGCTGGTGGGCAAGCTGAACTGGGCCAGCCAGATCTACCCCGGCATCAAGGTGCGCCAG
CTGTGCAAGCTGCTGCGCGGCGCCAAGGCCCTGACCGACATCGTGCCCCTGACCGAGGAGGCCGAGCTG
GAGCTGGCCGAGAACCGCGAGATCCTGCGCGAGCCCGTGCACGGCGTGTACTACGACCCCAGCAAGGAC
CTGGTGGCCGAGATCCAGAAGCAGGGCCACGACCAGTGGACCTACCAGATCTACCAGGAGCCCTTCAAG
AACCTGAAGACCGGCAAGTACGCCAAGATGCGCACCGCCCACACCAACGACGTGAAGCAGCTGACCGAG
GCCGTGCAGAAGATCGCCATGGAGAGCATCGTGATCTGGGGCAAGACCCCCAAGTTCCGCCTGCCCATC
CAGAAGGAGACCTGGGAGACCTGGTGGACCGACTACTGGCAGGCCACCTGGATCCCCGAGTGGGAGTTC
GTGAACACCCCCCCCCTGGTGAAGCTGTGGTACCAGCTGGAGAAGGAGCCCATCATCGGCGCCGAGACC
TTCTACGTGGACGGCGCCGCCAACCGCGAGACCAAGATCGGCAAGGCCGGCTACGTGACCGACCGGGGC
CGGCAGAAGATCGTGAGCCTGACCGAGACCACCAACCAGAAGACCGAGCTGCAGGCCATCCAGCTGGCC
CTGCAGGACAGCGGCAGCGAGGTGAACATCGTGACCGACAGCCAGTACGCCCTGGGCATCATCCAGGCC
CAGCCCGACAAGAGCGAGAGCGAGCTGGTGAACCAGATCATCGAGCAGCTGATCAAGAAGGAGAAGGTG
TACCTGAGCTGGGTGCCCGCCCACAAGGGCATCGGCGGCAACGAGCAGATCGACAAGCTGGTGAGCAAG
```

Figure 6B

GGCATCCGCAAGGTGCTGTTCCTGGACGGCATCGATGGCGGCATCGTGATCTACCAGTACATGGACGAC
CTGTACGTGGGCAGCGGCGGCCCTAGGATCGATTAAAAGCTTCCCGGGGCTAGCACCGGTTCTAGA

Figure 7A

GagComplPolmutAtt_C

```
GCCACCATGGGCGCCCGCGCCAGCATCCTGCGCGGCGGCAAGCTGGACGCCTGGGAGCGC
ATCCGCCTGCGCCCCGGCGGCAAGAAGTGCTACATGATGAAGCACCTGGTGTGGGCCAGC
CGCGAGCTGGAGAAGTTCGCCCTGAACCCCGGCCTGCTGGAGACCAGCGAGGGCTGCAAG
CAGATCATCCGCCAGCTGCACCCCGCCCTGCAGACCGGCAGCGAGGAGCTGAAGAGCCTG
TTCAACACCGTGGCCACCCTGTACTGCGTGCACGAGAAGATCGAGGTCCGCGACACCAAG
GAGGCCCTGGACAAGATCGAGGAGGAGCAGAACAAGTGCCAGCAGAAGATCCAGCAGGC
CGAGGCCGCCGACAAGGGCAAGGTGAGCCAGAACTACCCCATCGTGCAGAACCTGCAGG
GCCAGATGGTGCACCAGGCCATCAGCCCCGCACCCTGAACGCCTGGGTGAAGGTGATCG
AGGAGAAGGCCTTCAGCCCCGAGGTGATCCCCATGTTCACCGCCCTGAGCGAGGGCGCCA
CCCCCCAGGACCTGAACACGATGTTGAACACCGTGGGCGGCCACCAGGCCGCCATGCAGA
TGCTGAAGGACACCATCAACGAGGAGGCCGCCGAGTGGGACCGCGTGCACCCCGTGCAC
GCCGGCCCCATCGCCCCCGGCCAGATGCGCGAGCCCCGCGGCAGCGACATCGCCGGCACC
ACCAGCACCCTGCAGGAGCAGATCGCCTGGATGACCAGCAACCCCCCCATCCCCGTGGGC
GACATCTACAAGCGGTGGATCATCCTGGGCCTGAACAAGATCGTGCGGATGTACAGCCCC
GTGAGCATCCTGGACATCAAGCAGGGCCCCAAGGAGCCCTTCCGCGACTACGTGGACCGC
TTCTTCAAGACCCTGCGCGCCGAGCAGCAGACACCCAGGAGGTGAAGAACTGGATGACCGAC
ACCCTGCTGGTGCAGAACGCCAACCCCGACTGCAAGACCATCCTGCGCGCTCTCGGCCCC
GGCGCCAGCCTGGAGGAGATGATGACCGCCTGCCAGGGCGTGGGCGGCCCCAGCCACAA
GGCCCGCGTGCTGGCCGAGGCGATGAGCCAGGCCAACACCAGCGTGATGATGCAGAAGA
GCAACTTCAAGGGCCCCCGGCGCATCGTCAAGTGCTTCAACTGCGGCAAGGAGGGCCACA
TCGCCCGCAACTGCCGCGCCCCCCGCAAGAAGGGCTGCTGGAAGTGCGGCAAGGAGGGC
CACCAGATGAAGGACTGCACCGAGCGCCAGGCCAACTTCCTGGGCAAGATCTGGCCCAGC
CACAAGGGCCGCCCCGGCAACTTCCTGCAGAGCCGCCCCGAGCCCACCGCCCCCCCCGCC
GAGAGCTTCCGCTTCGAGGAGACCACCCCCGGCCAGAAGCAGGAGAGCAAGGACCGCGA
GACCCTGACCAGCCTGAAGAGCCTGTTCGGCAACGACCCCCTGAGCCAAGAATTCGCCGA
GGCCATGAGCCAGGCCACCAGCGCCAACATCCTGATGCAGCGCAGCAACTTCAAGGGCCC
CAAGCGCATCATCAAGTGCTTCAACTGCGGCAAGGAGGGCCACATCGCCCGCAACTGCCG
CGCCCCCCGCAAGAAGGGCTGCTGGAAGTGCGGCAAGGAGGGCCACCAGATGAAGGACT
GCACCGAGCGCCAGGCCAACTTCTTCCGCGAGGACCTGGCCTTCCCCCAGGGCAAGGCCC
GCGAGTTCCCCAGCGAGCAGAACCGCGCCAACAGCCCCACCAGCCGCGAGCTGCAGGTGC
GCGGCGACAACCCCCGCAGCGAGGCCGGCGCCGAGCGCCAGGGCACCCTGAACTTCCCCC
AGATCACCCTGTGGCAGCGCCCCCTGGTGAGCATCAAGGTGGGCGGCCAGATCAAGGAGG
CCCTGCTGGACTCCGGCGCCGACGACACCGTGCTGGAGGAGATGAGCCTGCCCGGCAAGT
GGAAGCCCAAGATGATCGGCGGCATCGGCGGCTTCATCAAGGTGCGCCAGTACGACCAGA
TCCTGATCGAGATCTGCGGCAAGAAGGCCATCGGCACCGTGCTGATCGGCCCCACCCCCG
TGAACATCATCGGCCGCAACATGCTGACCCAGCTGGGCTGCACCCTGAACTTCCCCATCA
GCCCCATCGAGACCGTGCCCGTGAAGCTGAAGCCCGGCATGGACGGCCCCAAGGTGAAGC
AGTGGCCCCTGACCGAGGAGAAGATCAAGGCCCTGACCGCCATCTGCGAGGAGATGGAG
AAGGAGGGCAAGATCACCAAGATCGGCCCCGAGAACCCCTACAACACCCCCGTGTTCGCC
ATCAAGAAGAAGGACAGCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAA
GAAGAAGAGCGTGACCGTGCTGGACGTGGGCGACGCCTACTTCAGCGTGCCCCTGGACGA
GGACTTCCGCAAGTACACCGCCTTCACCATCCCCAGCATCAACAACGAGACCCCCGGCAT
CCGCTACCAGTACAACGTGCTGCCCCAGGGCTGGAAGGGCAGCCCCAGCATCTTCCAGAG
CAGCATGACCAAGATCCTGGAGCCCTTCCGCGCCCGCAACCCCGAGATCGTGATCTACCA
GGCCCCCCTGTACGTGGGCAGCGACCTGGAGATCGGCCAGCACCGCGCCAAGATCGAGGA
GCTGCGCAAGCACCTGCTGCGCTGGGGCTTCACCACCCCCGACAAGAAGCACCAGAAGGA
GCCCCCCTTCCTGCCCATCGAGCTGCACCCCGACAAGTGGACCGTGCAGCCCATCGAGCT
GCCCGAGAAGGAGAGCTGGACCGTGAACGACATCCAGAAGCTGGTGGGCAAGCTGAACT
GGGCCAGCCAGATCTACCCCGGCATCAAGGTGCGCCAGCTGTGCAAGCTGCTGCGCGGCG
CCAAGGCCCTGACCGACATCGTGCCCCTGACCGAGGAGGCCGAGCTGGAGCTGGCCGAGA
ACCGCGAGATCCTGCGCGAGCCCGTGCACGGCGTGTACTACGACCCCAGCAAGGACCTGG
TGGCCGAGATCCAGAAGCAGGGCCACGACCAGTGGACCTACCAGATCTACCAGGAGCCCT
TCAAGAACCTGAAGACCGGCAAGTACGCCAAGATGCGCACCGCCCACACCAACGACGTG
AAGCAGCTGACCGAGGCCGTGCAGAAGATCGCCATGGAGAGCATCGTGATCTGGGGCAA
```

Figure 7B

```
GACCCCCAAGTTCCGCCTGCCCATCCAGAAGGAGACCTGGGAGACCTGGTGGACCGACTA
CTGGCAGGCCACCTGGATCCCCGAGTGGGAGTTCGTGAACACCCCCCCCCTGGTGAAGCT
GTGGTACCAGCTGGAGAAGGAGCCCATCATCGGCGCCGAGACCTTCTACGTGGACGGCGC
CGCCAACCGCGAGACCAAGATCGGCAAGGCCGGCTACGTGACCGACCGGGGCCGGCAGA
AGATCGTGAGCCTGACCGAGACCACCAACCAGAAGACCGAGCTGCAGGCCATCCAGCTG
GCCCTGCAGGACAGCGGCAGCGAGGTGAACATCGTGACCGACAGCCAGTACGCCCTGGG
CATCATCCAGGCCCAGCCCGACAAGAGCGAGAGCGAGCTGGTGAACCAGATCATCGAGC
AGCTGATCAAGAAGGAGAAGGTGTACCTGAGCTGGGTGCCCGCCCACAAGGGCATCGGC
GGCAACGAGCAGATCGACAAGCTGGTGAGCAAGGGCATCCGCAAGGTGCTGTTCCTGGAC
GGCATCGATGGCGGCATCGTGATCTACCAGTACATGGACGACCTGTACGTGGGCAGCGGC
GGCCCTAGGATCGATTAAAAGCTTCCCGGGGCTAGCACCGGTTCTAGA
```

Figure 8A

GagComplPolmutIna_C

```
GCCACCATGGGCGCCCGCGCCAGCATCCTGCGCGGCGGCAAGCTGGACGCCTGGGAGCGC
ATCCGCCTGCGCCCCGGCGGCAAGAAGTGCTACATGATGAAGCACCTGGTGTGGGCCAGC
CGCGAGCTGGAGAAGTTCGCCCTGAACCCCGGCCTGCTGGAGACCAGCGAGGGCTGCAAG
CAGATCATCCGCCAGCTGCACCCCGCCCTGCAGACCGGCAGCGAGGAGCTGAAGAGCCTG
TTCAACACCGTGGCCACCCTGTACTGCGTGCACGAGAAGATCGAGGTCCGCGACACCAAG
GAGGCCCTGGACAAGATCGAGGAGGAGCAGAACAAGTGCCAGCAGAAGATCCAGCAGGC
CGAGGCCGCCGACAAGGGCAAGGTGAGCCAGAACTACCCCATCGTGCAGAACCTGCAGG
GCCAGATGGTGCACCAGGCCATCAGCCCCCGCACCCTGAACGCCTGGGTGAAGGTGATCG
AGGAGAAGGCCTTCAGCCCCGAGGTGATCCCCATGTTCACCGCCCTGAGCGAGGGCGCCA
CCCCCCAGGACCTGAACACGATGTTGAACACCGTGGGCGGCCACCAGGCCGCCATGCAGA
TGCTGAAGGACACCATCAACGAGGAGGCCGCCGAGTGGGACCGCGTGCACCCCGTGCAC
GCCGGCCCCATCGCCCCCGGCCAGATGCGCGAGCCCCGCGGCAGCGACATCGCCGGCACC
ACCAGCACCCTGCAGGAGCAGATCGCCTGGATGACCAGCAACCCCCCCATCCCCGTGGGC
GACATCTACAAGCGGTGGATCATCCTGGGCCTGAACAAGATCGTGCGGATGTACAGCCCC
GTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGAC
ACCCTGCTGGTGCAGAACGCCAACCCCGACTGCAAGACCATCCTGCGCGCTCTCGGCCCC
GGCGCCAGCCTGGAGGAGATGATGACCGCCTGCCAGGGCGTGGGCGGCCCCAGCCACAA
GGCCCGCGTGCTGGCCGAGGCGATGAGCCAGGCCAACACCAGCGTGATGATGCAGAAGA
GCAACTTCAAGGGCCCCCGGCGCATCGTCAAGTGCTTCAACTGCGGCAAGGAGGGCCACA
TCGCCCGCAACTGCCGCGCCCCCCGCAAGAAGGGCTGCTGGAAGTGCGGCAAGGAGGGC
CACCAGATGAAGGACTGCACCGAGCGCCAGGCCAACTTCCTGGGCAAGATCTGGCCCAGC
CACAAGGGCCGCCCCGGCAACTTCCTGCAGAGCCGCCCCGAGCCCACCGCCCCCCCGCC
GAGAGCTTCCGCTTCGAGGAGACCACCCCCGGCCAGAAGCAGGAGAGCAAGGACCGCGA
GACCCTGACCAGCCTGAAGAGCCTGTTCGGCAACGACCCCCTGAGCCAAGAATTCGCCGA
GGCCATGAGCCAGGCCACCAGCGCCAACATCCTGATGCAGCGCAGCAACTTCAAGGGCCC
CAAGCGCATCATCAAGTGCTTCAACTGCGGCAAGGAGGGCCACATCGCCCGCAACTGCCG
CGCCCCCCGCAAGAAGGGCTGCTGGAAGTGCGGCAAGGAGGGCCACCAGATGAAGGACT
GCACCGAGCGCCAGGCCAACTTCTTCCGCGAGGACCTGGCCTTCCCCCAGGGCAAGGCCC
GCGAGTTCCCCAGCGAGCAGAACCGCGCCAACAGCCCCACCAGCCGCGAGCTGCAGGTGC
GCGGCGACAACCCCCGCAGCGAGGCCGGCGCCGAGCGCCAGGGCACCCTGAACTTCCCCC
AGATCACCCTGTGGCAGCGCCCCCTGGTGAGCATCAAGGTGGGCGGCCAGATCAAGGAGG
CCCTGCTGGCCACCGGCGCCGACGACACCGTGCTGGAGGAGATGAGCCTGCCCGGCAAGT
GGAAGCCCAAGATGATCGGCGGCATCGGCGGCTTCATCAAGGTGCGCCAGTACGACCAGA
TCCTGATCGAGATCTGCGGCAAGAAGGCCATCGGCACCGTGCTGATCGGCCCCACCCCCG
TGAACATCATCGGCCGCAACATGCTGACCCAGCTGGGCTGCACCCTGAACTTCCCCATCA
GCCCCATCGAGACCGTGCCCGTGAAGCTGAAGCCCGGCATGGACGGCCCCAAGGTGAAGC
AGTGGCCCCTGACCGAGGAGAAGATCAAGGCCCTGACCGCCATCTGCGAGGAGATGGAG
AAGGAGGGCAAGATCACCAAGATCGGCCCCGAGAACCCCTACAACACCCCCGTGTTCGCC
ATCAAGAAGAAGGACAGCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAA
GAAGAAGAGCGTGACCGTGCTGGACGTGGGCGACGCCTACTTCAGCGTGCCCCTGGACGA
GGACTTCCGCAAGTACACCGCCTTCACCATCCCCAGCATCAACAACGAGACCCCCGGCAT
CCGCTACCAGTACAACGTGCTGCCCCAGGGCTGGAAGGGCAGCCCCAGCATCTTCCAGAG
CAGCATGACCAAGATCCTGGAGCCCTTCCGCGCCCGCAACCCCGAGATCGTGATCTACCA
GGCCCCCCTGTACGTGGGCAGCGACCTGGAGATCGGCCAGCACCGCGCCAAGATCGAGGA
GCTGCGCAAGCACCTGCTGCGCTGGGGCTTCACCACCCCCGACAAGAAGCACCAGAAGGA
GCCCCCCTTCCTGCCCATCGAGCTGCACCCCGACAAGTGGACCGTGCAGCCCATCGAGCT
GCCCGAGAAGGAGAGCTGGACCGTGAACGACATCCAGAAGCTGGTGGGCAAGCTGAACT
GGGCCAGCCAGATCTACCCCGGCATCAAGGTGCGCCAGCTGTGCAAGCTGCTGCGCGGCG
CCAAGGCCCTGACCGACATCGTGCCCCTGACCGAGGAGGCCGAGCTGGAGCTGGCCGAGA
ACCGCGAGATCCTGCGCGAGCCCGTGCACGGCGTGTACTACGACCCCAGCAAGGACCTGG
TGGCCGAGATCCAGAAGCAGGGCCACGACCAGTGGACCTACCAGATCTACCAGGAGCCCT
TCAAGAACCTGAAGACCGGCAAGTACGCCAAGATGCGCACCGCCCACACCAACGACGTG
AAGCAGCTGACCGAGGCCGTGCAGAAGATCGCCATGGAGAGCATCGTGATCTGGGGCAA
```

Figure 8B

```
GACCCCCAAGTTCCGCCTGCCCATCCAGAAGGAGACCTGGGAGACCTGGTGGACCGACTA
CTGGCAGGCCACCTGGATCCCCGAGTGGGAGTTCGTGAACACCCCCCCCCTGGTGAAGCT
GTGGTACCAGCTGGAGAAGGAGCCCATCATCGGCGCCGAGACCTTCTACGTGGACGGCGC
CGCCAACCGCGAGACCAAGATCGGCAAGGCCGGCTACGTGACCGACCGGGGCCGGCAGA
AGATCGTGAGCCTGACCGAGACCACCAACCAGAAGACCGAGCTGCAGGCCATCCAGCTG
GCCCTGCAGGACAGCGGCAGCGAGGTGAACATCGTGACCGACAGCCAGTACGCCCTGGG
CATCATCCAGGCCCAGCCCGACAAGAGCGAGAGCGAGCTGGTGAACCAGATCATCGAGC
AGCTGATCAAGAAGGAGAAGGTGTACCTGAGCTGGGTGCCCGCCCACAAGGGCATCGGC
GGCAACGAGCAGATCGACAAGCTGGTGAGCAAGGGCATCCGCAAGGTGCTGTTCCTGGAC
GGCATCGATGGCGGCATCGTGATCTACCAGTACATGGACGACCTGTACGTGGGCAGCGGC
GGCCCTAGGATCGATTAAAAGCTTCCCGGGGCTAGCACCGGTTCTAGA
```

Figure 9A

GagComplPolmutInaTatRevNef_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCAAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAAGAATTCGCCGAGGCCATGAGCCAGGCCACCAGCGCC
AACATCCTGATGCAGCGCAGCAACTTCAAGGGCCCCAAGCGCATCATCAAGTGCTTCAACTGCGGCAAG
GAGGGCCACATCGCCCGCAACTGCCGCGCCCCCCGCAAGAAGGGCTGCTGGAAGTGCGGCAAGGAGGGC
CACCAGATGAAGGACTGCACCGAGCGCCAGGCCAACTTCTTCCGCGAGGACCTGGCCTTCCCCCAGGGC
AAGGCCCGCGAGTTCCCCAGCGAGCAGAACCGCGCCAACAGCCCCACCAGCCGCGAGCTGCAGGTGCGC
GGCGACAACCCCGCAGCGAGGCGGCGCCGAGCGCCAGGGCACCCTGAACTTCCCCCAGATCACCCTG
TGGCAGCGCCCCCTGGTGAGCATCAAGGTGGGCGGCCAGATCAAGGAGGCCCTGCTGGCCACCGGCGCC
GACGACACCGTGCTGGAGGAGATGAGCCTGCCCGGCAAGTGGAAGCCCAAGATGATCGGCGGCATCGGC
GGCTTCATCAAGGTGCGCCAGTACGACCAGATCCTGATCGAGATCTGCGGCAAGAAGGCCATCGGCACC
GTGCTGATCGGCCCCACCCCCGTGAACATCATCGGCCGCAACATGCTGACCCAGCTGGGCTGCACCCTG
AACTTCCCCATCAGCCCCATCGAGACCGTGCCCGTGAAGCTGAAGCCCGGCATGGACGGCCCCAAGGTG
AAGCAGTGGCCCCTGACCGAGGAGAAGATCAAGGCCCTGACCGCCATCTGCGAGGAGATGGAGAAGGAG
GGCAAGATCACCAAGATCGGCCCCGAGAACCCCTACAACACCCCCGTGTTCGCCATCAAGAAGAAGGAC
AGCACCAAGTGGCGCAAGCTGGTGGACTTCCGCGAGCTGAACAAGCGCACCCAGGACTTCTGGGAGGTG
CAGCTGGGCATCCCCCACCCCGCCGGCCTGAAGAAGAAGAAGAGCGTGACCGTGCTGGACGTGGGCGAC
GCCTACTTCAGCGTGCCCCTGGACGAGGACTTCCGCAAGTACACCGCCTTCACCATCCCCAGCATCAAC
AACGAGACCCCCGGCATCCGCTACCAGTACAACGTGCTGCCCCAGGGCTGGAAGGGCAGCCCCAGCATC
TTCCAGAGCAGCATGACCAAGATCCTGGAGCCCTTCCGCGCCCGCAACCCCGAGATCGTGATCTACCAG
GCCCCCCTGTACGTGGGCAGCGACCTGGAGATCGGCCAGCACCGCACCAAGATCGAGGAGCTGCGCAAG
CACCTGCTGCGCTGGGGCTTCACCACCCCCGACAAGAAGCACCAGAAGGAGCCCCCCTTCCTGCCCATC
GAGCTGCACCCCGACAAGTGGACCGTGCAGCCCATCGAGCTGCCCGAGAAGGAGAGCTGGACCGTGAAC
GACATCCAGAAGCTGGTGGGCAAGCTGAACTGGGCCAGCCAGATCTACCCCGGCATCAAGGTGCGCCAG
CTGTGCAAGCTGCTGCGCGGCGCCAAGGCCCTGACCGACATCGTGCCCCTGACCGAGGAGGCCGAGCTG
GAGCTGGCCGAGAACCGCGAGATCCTGCGCGAGCCCGTGCACGGCGTGTACTACGACCCCAGCAAGGAC
CTGGTGGCCGAGATCCAGAAGCAGGGCCACGACCAGTGGACCTACCAGATCTACCAGGAGCCCTTCAAG
AACCTGAAGACCGGCAAGTACGCCAAGATGCGCACCGCCCACACCAACGACGTGAAGCAGCTGACCGAG
GCCGTGCAGAAGATCGCCATGGAGAGCATCGTGATCTGGGGCAAGACCCCCAAGTTCCGCCTGCCCATC
CAGAAGGAGACCTGGGAGACCTGGTGGACCGACTACTGGCAGGCCACCTGGATCCCCGAGTGGGAGTTC
GTGAACACCCCCCCCCTGGTGAAGCTGTGGTACCAGCTGGAGAAGGAGCCCATCATCGGCGCCGAGACC
TTCTACGTGGACGGCGCCGCCAACCGCGAGACCAAGATCGGCAAGGCCGGCTACGTGACCGACCGGGGC
CGGCAGAAGATCGTGAGCCTGACCGAGACCACCAACCAGAAGACCGAGCTGCAGGCCATCCAGCTGGCC
CTGCAGGACAGCGGCAGCGAGGTGAACATCGTGACCGACAGCCAGTACGCCCTGGGCATCATCCAGGCC
CAGCCCGACAAGAGCGAGAGCGAGCTGGTGAACCAGATCATCGAGCAGCTGATCAAGAAGGAGAAGGTG
TACCTGAGCTGGGTGCCCGCCCACAAGGGCATCGGCGGCAACGAGCAGATCGACAAGCTGGTGAGCAAG
GGCATCCGCAAGGTGCTGTTCCTGGACGGCATCGATGGCGGCATCGTGATCTACCAGTACATGGACGAC
```

Figure 9B

```
CTGTACGTGGGCAGCGGCGGCCCTAGGGAGCCCGTGGACCCCAACCTGGAGCCCTGGAACCACCCCGGC
AGCCAGCCCAAGACCGCCGGCAACAAGTGCTACTGCAAGCACTGCAGCTACCACTGCCTGGTGAGCTTC
CAGACCAAGGGCCTGGGCATCAGCTACGGCCGCAAGAAGCGCCGCCAGCGCCGCAGCGCCCCCCCCAGC
AGCGAGGACCACCAGAACCCCATCAGCAAGCAGCCCCTGCCCCAGACCCGCGGCGACCCCACCGGCAGC
GAGGAGAGCAAGAAGAAGGTGGAGAGCAAGACCGAGACCGACCCCTTCGACCCCGGGGCCGGCCGCAGC
GGCGACAGCGACGAGGCCCTGCTGCAGGCCGTGCGCATCATCAAGATCCTGTACCAGAGCAACCCCTAC
CCCAAGCCCGAGGGCACCCGCCAGGCCGACCTGAACGCCGCCGCCGCTGGCGCGCCCGCCAGCGCCAG
ATCCACAGCATCAGCGAGCGCATCCTGAGCACCTGCCTGGGCCGCCCCGCCGAGCCCGTGCCCTTCCAG
CTGCCCCCCGACCTGCGCCTGCACATCGACTGCAGCGAGAGCAGCGGCACCAGCGGCACCCAGCAGAGC
CAGGGCACCACCGAGGGCGTGGGCAGCCCCCTCGAGGCCGGCAAGTGGAGCAAGAGCAGCATCGTGGGC
TGGCCCGCCGTGCGCGAGCGCATCCGCCGCACCGAGCCCGCCGCCGAGGGCGTGGGCGCCGCCAGCCAG
GACCTGGACAAGCACGGCGCCCTGACCAGCAGCAACACCGCCGCCAACAACGCCGACTGCGCCTGGCTG
GAGGCCCAGGAGGAGGAGGAGGAGGTGGGCTTCCCCGTGCGCCCCAGGTGCCCCTGCGCCCCATGACC
TACAAGGCCGCCTTCGACCTGAGCTTCTTCCTGAAGGAGAAGGGCGGCCTGGAGGGCCTGATCTACAGC
AAGAAGCGCCAGGAGATCCTGGACCTGTGGGTGTACCACACCCAGGGCTTCTTCCCCGGCTGGCAGAAC
TACACCCCGGCCCCGGCGTGCGCTACCCCCTGACCTTCGGCTGGTGCTTCAAGCTGGTGCCCGTGGAC
CCCCGCGAGGTGGAGGAGGCCAACAAGGGCGAGAACAACTGCCTGCTGCACCCCATGAGCCAGCACGGC
ATGGAGGACGAGGACCGCGAGGTGCTGAAGTGGAAGTTCGACAGCAGCCTGGCCCGCCGCCACATGGCC
CGCGAGCTGCACCCCGAGTACTACAAGGACTGCGCCTAA
```

Figure 10

GagPolmut_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTTAAAAAGGGCCCCAAGCGCATCATCAAGTGC
TTCAACTGCGGCAAGGAGGGCCACATCGCCCGCAACTGCCGCGCCCCCGCAAGAAGGGCTGCTGGAAG
TGCGGCAAGGAGGGCCACCAGATGAAGGACTGCACCGAGCGCCAGGCCAACTTCTTCCGCGAGGACCTG
GCCTTCCCCCAGGGCAAGGCCCGCGAGTTCCCCAGCGAGCAGAACCGCGCCAACAGCCCCACCAGCCGC
GAGCTGCAGGTGCGCGGCGACAACCCCCGCAGCGAGGCCGGCGCCGAGCGCCAGGGCACCCTGAACTTC
CCCCAGATCACCCTGTGGCAGCGCCCCCTGGTGAGCATCAAGGTGGGCGGCCAGATCAAGGAGGCCCTG
CTGGACACCGGCGCCGACGACACCGTGCTGGAGGAGATGAGCCTGCCCGGCAAGTGGAAGCCCAAGATG
ATCGGCGGCATCGGCGGCTTCATCAAGGTGCGCCAGTACGACCAGATCCTGATCGAGATCTGCGGCAAG
AAGGCCATCGGCACCGTGCTGATCGGCCCCACCCCCGTGAACATCATCGGCCGCAACATGCTGACCCAG
CTGGGCTGCACCCTGAACTTCCCCATCAGCCCCATCGAGACCGTGCCCGTGAAGCTGAAGCCCGGCATG
GACGGCCCCAAGGTGAAGCAGTGGCCCCTGACCGAGGAGAAGATCAAGGCCCTGACCGCCATCTGCGAG
GAGATGGAGAAGGAGGGCAAGATCACCAAGATCGGCCCCGAGAACCCCTACAACACCCCCGTGTTCGCC
ATCAAGAAGAAGGACAGCACCAAGTGGCGCAAGCTGGTGGACTTCCGCGAGCTGAACAAGCGCACCCAG
GACTTCTGGGAGGTGCAGCTGGGCATCCCCCACCCCGCCGGCCTGAAGAAGAAGAAGAGCGTGACCGTG
CTGGACGTGGGCGACGCCTACTTCAGCGTGCCCCTGGACGAGGACTTCCGCAAGTACACCGCCTTCACC
ATCCCCAGCATCAACAACGAGACCCCCGGCATCCGCTACCAGTACAACGTGCTGCCCCAGGGCTGGAAG
GGCAGCCCCAGCATCTTCCAGAGCAGCATGACCAAGATCCTGGAGCCCTTCCGCGCCCGCAACCCCGAG
ATCGTGATCTACCAGGCCCCCCTGTACGTGGGCAGCGACCTGGAGATCGGCCAGCACCGCGCCAAGATC
GAGGAGCTGCGCAAGCACCTGCTGCGCTGGGGCTTCACCACCCCCGACAAGAAGCACCAGAAGGAGCCC
CCCTTCCTGCCCATCGAGCTGCACCCCGACAAGTGGACCGTGCAGCCCATCGAGCTGCCCGAGAAGGAG
AGCTGGACCGTGAACGACATCCAGAAGCTGGTGGGCAAGCTGAACTGGGCCAGCCAGATCTACCCCGGC
ATCAAGGTGCGCCAGCTGTGCAAGCTGCTGCGCGGCGCCAAGGCCCTGACCGACATCGTGCCCCTGACC
GAGGAGGCCGAGCTGGAGCTGGCCGAGAACCGCGAGATCCTGCGCGAGCCCGTGCACGGCGTGTACTAC
GACCCCAGCAAGGACCTGGTGGCCGAGATCCAGAAGCAGGGCCACGACCAGTGGACCTACCAGATCTAC
CAGGAGCCCTTCAAGAACCTGAAGACCGGCAAGTACGCCAAGATGCGCACCGCCCACACCAACGACGTG
AAGCAGCTGACCGAGGCCGTGCAGAAGATCGCCATGGAGAGCATCGTGATCTGGGGCAAGACCCCCAAG
TTCCGCCTGCCCATCCAGAAGGAGACCTGGGAGACCTGGTGGACCGACTACTGGCAGGCCACCTGGATC
CCCGAGTGGGAGTTCGTGAACACCCCCCCCCTGGTGAAGCTGTGGTACCAGCTGGAGAAGGAGCCCATC
ATCGGCGCCGAGACCTTCTACGTGGACGGCGCCGCCAACCGCGAGACCAAGATCGGCAAGGCCGGCTAC
GTGACCGACCGGGGCCGGCAGAAGATCGTGAGCCTGACCGAGACCACCAACCAGAAGACCGAGCTGCAG
GCCATCCAGCTGGCCCTGCAGGACAGCGGCAGCGAGGTGAACATCGTGACCGACAGCCAGTACGCCCTG
GGCATCATCCAGGCCCAGCCCGACAAGAGCGAGAGCGAGCTGGTGAACCAGATCATCGAGCAGCTGATC
AAGAAGGAGAAGGTGTACCTGAGCTGGGTGCCCGCCCACAAGGGCATCGGCGGCAACGAGCAGATCGAC
AAGCTGGTGAGCAAGGGCATCCGCAAGGTGCTGTTCCTGGACGGCATCGATGGCGGCATCGTGATCTAC
CAGTACATGGACGACCTGTACGTGGGCAGCGGCGGCCCTAGGATCGATTAAAAGCTTCCCGGGGCTAGC
ACCGGTTCTAGA
```

Figure 11

GagPolmutAtt_C

```
GTCGACGCCACCATGGGCGCCCGCGCCAGCATCCTGCGCGGCGGCAAGCTGGACGCCTGGGAGCGCATC
CGCCTGCGCCCCGGCGGCAAGAAGTGCTACATGATGAAGCACCTGGTGTGGGCCAGCCGCGAGCTGGAG
AAGTTCGCCCTGAACCCCGGCCTGCTGGAGACCAGCGAGGGCTGCAAGCAGATCATCCGCCAGCTGCAC
CCCGCCCTGCAGACCGGCAGCGAGGAGCTGAAGAGCCTGTTCAACACCGTGGCCACCCTGTACTGCGTG
CACGAGAAGATCGAGGTCCGCGACACCAAGGAGGCCCTGGACAAGATCGAGGAGGAGCAGAACAAGTGC
CAGCAGAAGATCCAGCAGGCCGAGGCCGCCGACAAGGGCAAGGTGAGCCAGAACTACCCCATCGTGCAG
AACCTGCAGGGCCAGATGGTGCACCAGGCCATCAGCCCCGCACCCTGAACGCCTGGGTGAAGGTGATC
GAGGAGAAGGCCTTCAGCCCCGAGGTGATCCCCATGTTCACCGCCCTGAGCGAGGGCGCCACCCCCCAG
GACCTGAACACGATGTTGAACACCGTGGGCGGCACCAGGCCGCCATGCAGATGCTGAAGGACACCATC
AACGAGGAGGCCGCCGAGTGGGACGCGTGCACCCCGTGCACGCCGGCCCCATCGCCCCCGGCCAGATG
CGCGAGCCCGCGGCAGCGACATCGCCGGCACCACCAGCACCCTGCAGGAGCAGATCGCCTGGATGACC
AGCAACCCCCCCATCCCCGTGGGCGACATCTACAAGCGGTGGATCATCCTGGGCCTGAACAAGATCGTG
CGGATGTACAGCCCCGTGAGCATCCTGGACATCAAGCAGGGCCCCAAGGAGCCCTTCCGCGACTACGTG
GACCGCTTCTTCAAGACCCTGCGCGCCGAGCAGAGCACCCAGGAGGTGAAGAACTGGATGACCGACACC
CTGCTGGTGCAGAACGCCAACCCCGACTGCAAGACCATCCTGCGCGCTCTCGGCCCCGGCGCCAGCCTG
GAGGAGATGATGACCGCCTGCCAGGGCGTGGGCGGCCCCAGCCACAAGGCCCGCGTGCTGGCCGAGGCG
ATGAGCCAGGCCAACACCAGCGTGATGATGCAGAAGAGCAACTTTAAAAAGGGCCCCAAGCGCATCATC
AAGTGCTTCAACTGCGGCAAGGAGGGCCACATCGCCCGCAACTGCCGCGCCCCCGCAAGAAGGGCTGC
TGGAAGTGCGGCAAGGAGGGCCACCAGATGAAGGACTGCACCGAGCGCCAGGCCAACTTCTTCCGCGAG
GACCTGGCCTTCCCCCAGGGCAAGGCCCGCGAGTTCCCCAGCGAGCAGAACCGCGCCAACAGCCCCACC
AGCCGCGAGCTGCAGGTGCGCGGCGACAACCCCCGCAGCGAGGCCGGCGCCGAGCGCCAGGGCACCCTG
AACTTCCCCCAGATCACCCTGTGGCAGCGCCCCCTGGTGAGCATCAAGGTGGGCGGCCAGATCAAGGAG
GCCCTGCTGGACTCCGGCGCCGACGACACCGTGCTGGAGGAGATGAGCCTGCCCGGCAAGTGGAAGCCC
AAGATGATCGGCGGCATCGGCGGCTTCATCAAGGTGCGCCAGTACGACCAGATCCTGATCGAGATCTGC
GGCAAGAAGGCCATCGGCACCGTGCTGATCGGCCCCACCCCCGTGAACATCATCGGCCGCAACATGCTG
ACCCAGCTGGGCTGCACCCTGAACTTCCCCATCAGCCCCATCGAGACCGTGCCCGTGAAGCTGAAGCCC
GGCATGGACGGCCCCAAGGTGAAGCAGTGGCCCCTGACCGAGGAGAAGATCAAGGCCCTGACCGCCATC
TGCGAGGAGATGGAGAAGGAGGGCAAGATCACCAAGATCGGCCCCGAGAACCCCTACAACACCCCCGTG
TTCGCCATCAAGAAGAAGGACAGCACCAAGTGGCGCAAGCTGGTGGACTTCCGCGAGCTGAACAAGCGC
ACCCAGGACTTCTGGGAGGTGCAGCTGGGCATCCCCCACCCCGCCGGCCTGAAGAAGAAGAAGAGCGTG
ACCGTGCTGGACGTGGGCGACGCCTACTTCAGCGTGCCCCTGGACGAGGACTTCCGCAAGTACACCGCC
TTCACCATCCCCAGCATCAACAACGAGACCCCCGGCATCCGCTACCAGTACAACGTGCTGCCCCAGGGC
TGGAAGGGCAGCCCCAGCATCTTCCAGAGCAGCATGACCAAGATCCTGGAGCCCTTCCGCGCCCGCAAC
CCCGAGATCGTGATCTACCAGGCCCCCCTGTACGTGGGCAGCGACCTGGAGATCGGCCAGCACCGCGCC
AAGATCGAGGAGCTGCGCAAGCACCTGCTGCGCTGGGGCTTCACCACCCCCGACAAGAAGCACCAGAAG
GAGCCCCCCTTCCTGCCCATCGAGCTGCACCCCGACAAGTGGACCGTGCAGCCCATCGAGCTGCCCGAG
AAGGAGAGCTGGACCGTGAACGACATCCAGAAGCTGGTGGGCAAGCTGAACTGGGCCAGCCAGATCTAC
CCCGGCATCAAGGTGCGCCAGCTGTGCAAGCTGCTGCGCGGCGCCAAGGCCCTGACCGACATCGTGCCC
CTGACCGAGGAGGCCGAGCTGGAGCTGGCCGAGAACCGCGAGATCCTGCGCGAGCCCGTGCACGGCGTG
TACTACGACCCCAGCAAGGACCTGGTGGCCGAGATCCAGAAGCAGGGCCACGACCAGTGGACCTACCAG
ATCTACCAGGAGCCCTTCAAGAACCTGAAGACCGGCAAGTACGCCAAGATGCGCACCGCCCACACCAAC
GACGTGAAGCAGCTGACCGAGGCCGTGCAGAAGATCGCCATGGAGAGCATCGTGATCTGGGGCAAGACC
CCCAAGTTCCGCCTGCCCATCCAGAAGGAGACCTGGGAGACCTGGTGGACCGACTACTGGCAGGCCACC
TGGATCCCCGAGTGGGAGTTCGTGAACACCCCCCCCTGGTGAAGCTGTGGTACCAGCTGGAGAAGGAG
CCCATCATCGGCGCCGAGACCTTCTACGTGGACGGCGCCGCCAACCGCGAGACCAAGATCGGCAAGGCC
GGCTACGTGACCGACCGGGCCGGCAGAAGATCGTGAGCCTGACCGAGACCACCAACCAGAAGACCGAG
CTGCAGGCCATCCAGCTGGCCCTGCAGGACAGCGGCAGCGAGGTGAACATCGTGACCGACAGCCAGTAC
GCCCTGGGCATCATCCAGGCCCAGCCCGACAAGAGCGAGAGCGAGCTGGTGAACCAGATCATCGAGCAG
CTGATCAAGAAGGAGAAGGTGTACCTGAGCTGGGTGCCCGCCCACAAGGGCATCGGCGGCAACGAGCAG
ATCGACAAGCTGGTGAGCAAGGGCATCCGCAAGGTGCTGTTCCTGGACGGCATCGATGGCGGCATCGTG
ATCTACCAGTACATGGACGACCTGTACGTGGGCAGCGGCGGCCCTAGGATCGATTAAAAGCTTCCCGGG
GCTAGCACCGGTTCTAGA
```

Figure 12

GagPolmutIna_C

```
GTCGACGCCACCATGGGCGCCCGCGCCAGCATCCTGCGCGGCGGCAAGCTGGACGCCTGGGAGCGCATC
CGCCTGCGCCCCGGCGGCAAGAAGTGCTACATGATGAAGCACCTGGTGTGGGCCAGCCGCGAGCTGGAG
AAGTTCGCCCTGAACCCCGGCCTGCTGGAGACCAGCGAGGGCTGCAAGCAGATCATCCGCCAGCTGCAC
CCCGCCCTGCAGACCGGCAGCGAGGAGCTGAAGAGCCTGTTCAACACCGTGGCCACCCTGTACTGCGTG
CACGAGAAGATCGAGGTCCGCGACACCAAGGAGGCCCTGGACAAGATCGAGGAGGAGCAGAACAAGTGC
CAGCAGAAGATCCAGCAGGCCGAGGCCGCCGACAAGGGCAAGGTGAGCCAGAACTACCCCATCGTGCAG
AACCTGCAGGGCCAGATGGTGCACCAGGCCATCAGCCCCCGCACCCTGAACGCCTGGGTGAAGGTGATC
GAGGAGAAGGCCTTCAGCCCCGAGGTGATCCCCATGTTCACCGCCCTGAGCGAGGGCGCCACCCCCCAG
GACCTGAACACGATGTTGAACACCGTGGGCGGCCACCAGGCCGCCATGCAGATGCTGAAGGACACCATC
AACGAGGAGGCCGCCGAGTGGGACCGCGTGCACCCCGTGCACGCCGGCCCCATCGCCCCCGGCCAGATG
CGCGAGCCCGCGGCAGCGACATCGCCGGCACCACCAGCACCCTGCAGGAGCAGATCGCCTGGATGACC
AGCAACCCCCCCATCCCCGTGGGCGACATCTACAAGCGGTGGATCATCCTGGGCCTGAACAAGATCGTG
CGGATGTACAGCCCCGTGAGCATCCTGGACATCAAGCAGGGCCCCAAGGAGCCCTTCCGCGACTACGTG
GACCGCTTCTTCAAGACCCTGCGCGCCGAGCAGAGCACCCAGGAGGTGAAGAACTGGATGACCGACACC
CTGCTGGTGCAGAACGCCAACCCCGACTGCAAGACCATCCTGCGCGCTCTCGGCCCCGGCGCCAGCCTG
GAGGAGATGATGACCGCCTGCCAGGGCGTGGGCGGCCCCAGCCACAAGGCCCGCGTGCTGGCCGAGGCG
ATGAGCCAGGCCAACACCAGCGTGATGATGCAGAAGAGCAACTTTAAAAAGGGCCCCAAGCGCATCATC
AAGTGCTTCAACTGCGGCAAGGAGGGCCACATCGCCCGCAACTGCCGCGCCCCCCGCAAGAAGGGCTGC
TGGAAGTGCGGCAAGGAGGGCCACCAGATGAAGGACTGCACCGAGCGCCAGGCCAACTTCTTCCGCGAG
GACCTGGCCTTCCCCCAGGGCAAGGCCCGCGAGTTCCCCAGCGAGCAGAACCGCGCCAACAGCCCCACC
AGCCGCGAGCTGCAGGTGCGCGGCGACAACCCCGCAGCGAGGCCGGCGCCGAGCGCCAGGGCACCCTG
AACTTCCCCCAGATCACCCTGTGGCAGCGCCCCCTGGTGAGCATCAAGGTGGGCGGCCAGATCAAGGAG
GCCCTGCTGGCCACCGGCGCCGACGACACCGTGCTGGAGGAGATGAGCCTGCCCGGCAAGTGGAAGCCC
AAGATGATCGGCGGCATCGGCGGCTTCATCAAGGTGCGCCAGTACGACCAGATCCTGATCGAGATCTGC
GGCAAGAAGGCCATCGGCACCGTGCTGATCGGCCCCACCCCCGTGAACATCATCGGCCGCAACATGCTG
ACCCAGCTGGGCTGCACCCTGAACTTCCCCATCAGCCCCATCGAGACCGTGCCCGTGAAGCTGAAGCCC
GGCATGGACGGCCCCAAGGTGAAGCAGTGGCCCCTGACCGAGGAGAAGATCAAGGCCCTGACCGCCATC
TGCGAGGAGATGGAGAAGGAGGGCAAGATCACCAAGATCGGCCCCGAGAACCCCTACAACACCCCCGTG
TTCGCCATCAAGAAGAAGGACAGCACCAAGTGGCGCAAGCTGGTGGACTTCCGCGAGCTGAACAAGCGC
ACCCAGGACTTCTGGGAGGTGCAGCTGGGCATCCCCCACCCCGCCGGCCTGAAGAAGAAGAAGAGCGTG
ACCGTGCTGGACGTGGGCGACGCCTACTTCAGCGTGCCCCTGGACGAGGACTTCCGCAAGTACACCGCC
TTCACCATCCCCAGCATCAACAACGAGACCCCCGGCATCCGCTACCAGTACAACGTGCTGCCCCAGGGC
TGGAAGGGCAGCCCCAGCATCTTCCAGAGCAGCATGACCAAGATCCTGGAGCCCTTCCGCGCCCGCAAC
CCCGAGATCGTGATCTACCAGGCCCCCCTGTACGTGGGCAGCGACCTGGAGATCGGCCAGCACCGCGCC
AAGATCGAGGAGCTGCGCAAGCACCTGCTGCGCTGGGGCTTCACCACCCCCGACAAGAAGCACCAGAAG
GAGCCCCCCTTCCTGCCCATCGAGCTGCACCCCGACAAGTGGACCGTGCAGCCCATCGAGCTGCCCGAG
AAGGAGAGCTGGACCGTGAACGACATCCAGAAGCTGGTGGGCAAGCTGAACTGGGCCAGCCAGATCTAC
CCCGGCATCAAGGTGCGCCAGCTGTGCAAGCTGCTGCGCGGCGCCAAGGCCCTGACCGACATCGTGCCC
CTGACCGAGGAGGCCGAGCTGGAGCTGGCCGAGAACCGCGAGATCCTGCGCGAGCCCGTGCACGGCGTG
TACTACGACCCCAGCAAGGACCTGGTGGCCGAGATCCAGAAGCAGGGCCACGACCAGTGGACCTACCAG
ATCTACCAGGAGCCCTTCAAGAACCTGAAGACCGGCAAGTACGCCAAGATGCGCACCGCCCACACCAAC
GACGTGAAGCAGCTGACCGAGGCCGTGCAGAAGATCGCCATGGAGAGCATCGTGATCTGGGGCAAGACC
CCCAAGTTCCGCCTGCCCATCCAGAAGGAGACCTGGGAGACCTGGTGGACCGACTACTGGCAGGCCACC
TGGATCCCCGAGTGGGAGTTCGTGAACACCCCCCCCTGGTGAAGCTGTGGTACCAGCTGGAGAAGGAG
CCCATCATCGGCGCCGAGACCTTCTACGTGGACGGCGCCGCCAACCGCGAGACCAAGATCGGCAAGGCC
GGCTACGTGACCGACCGGGGCCGGCAGAAGATCGTGAGCCTGACCGAGACCACCAACCAGAAGACCGAG
CTGCAGGCCATCCAGCTGGCCCTGCAGGACAGCGGCAGCGAGGTGAACATCGTGACCGACAGCCAGTAC
GCCCTGGGCATCATCCAGGCCCAGCCCGACAAGAGCGAGAGCGAGCTGGTGAACCAGATCATCGAGCAG
CTGATCAAGAAGGAGAAGGTGTACCTGAGCTGGGTGCCCGCCCACAAGGGCATCGGCGGCAACGAGCAG
ATCGACAAGCTGGTGAGCAAGGGCATCCGCAAGGTGCTGTTCCTGGACGGCATCGATGGCGGCATCGTG
ATCTACCAGTACATGGACGACCTGTACGTGGGCAGCGGCGGCCCTAGGATCGATTAAAAGCTTCCCGGG
GCTAGCACCGGTTCTAGA
```

Figure 13

GagProtInaRTmut_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAGAAAGAATTCCCCCAGATCACCCTGTGGCAGCGCCCC
CTGGTGAGCATCAAGGTGGGCGGCCAGATCAAGGAGGCCCTGCTGGCCACCGGCGCCGACGACACCGTG
CTGGAGGAGATGAGCCTGCCCGGCAAGTGGAAGCCCAAGATGATCGGCGGCATCGGCGGCTTCATCAAG
GTGCGCCAGTACGACCAGATCCTGATCGAGATCTGCGGCAAGAAGGCCATCGGCACCGTGCTGATCGGC
CCCACCCCCGTGAACATCATCGGCCGCAACATGCTGACCCAGCTGGGCTGCACCCTGAACTTCCCCATC
AGCCCCATCGAGACCGTGCCCGTGAAGCTGAAGCCCGGCATGGACGGCCCCAAGGTGAAGCAGTGGCCC
CTGACCGAGGAGAAGATCAAGGCCCTGACCGCCATCTGCGAGGAGATGGAGAAGGAGGGCAAGATCACC
AAGATCGGCCCCGAGAACCCCTACAACACCCCCGTGTTCGCCATCAAGAAGAAGGACAGCACCAAGTGG
CGCAAGCTGGTGGACTTCCGCGAGCTGAACAAGCGCACCCAGGACTTCTGGGAGGTGCAGCTGGGCATC
CCCCACCCCGCCGGCCTGAAGAAGAAGAAGAGCGTGACCGTGCTGGACGTGGGCGACGCCTACTTCAGC
GTGCCCCTGGACGAGGACTTCCGCAAGTACACCGCCTTCACCATCCCCAGCATCAACAACGAGACCCCC
GGCATCCGCTACCAGTACAACGTGCTGCCCCAGGGCTGGAAGGGCAGCCCCAGCATCTTCCAGAGCAGC
ATGACCAAGATCCTGGAGCCCTTCCGCGCCCGCAACCCCGAGATCGTGATCTACCAGGCCCCCCTGTAC
GTGGGCAGCGACCTGGAGATCGGCCAGCACCGCGCCAAGATCGAGGAGCTGCGCAAGCACCTGCTGCGC
TGGGGCTTCACCACCCCCGACAAGAAGCACCAGAAGGAGCCCCCCTTCCTGCCCATCGAGCTGCACCCC
GACAAGTGGACCGTGCAGCCCATCGAGCTGCCCGAGAAGGAGAGCTGGACCGTGAACGACATCCAGAAG
CTGGTGGGCAAGCTGAACTGGGCCAGCCAGATCTACCCCGGCATCAAGGTGCGCCAGCTGTGCAAGCTG
CTGCGCGGCGCCAAGGCCCTGACCGACATCGTGCCCCTGACCGAGGAGGCCGAGCTGGAGCTGGCCGAG
AACCGCGAGATCCTGCGCGAGCCCGTGCACGGCGTGTACTACGACCCCAGCAAGGACCTGGTGGCCGAG
ATCCAGAAGCAGGGCCACGACCAGTGGACCTACCAGATCTACCAGGAGCCCTTCAAGAACCTGAAGACC
GGCAAGTACGCCAAGATGCGCACCGCCCACACCAACGACGTGAAGCAGCTGACCGAGGCCGTGCAGAAG
ATCGCCATGGAGAGCATCGTGATCTGGGGCAAGACCCCCAAGTTCCGCCTGCCCATCCAGAAGGAGACC
TGGGAGACCTGGTGGACCGACTACTGGCAGGCCACCTGGATCCCCGAGTGGGAGTTCGTGAACACCCCC
CCCCTGGTGAAGCTGTGGTACCAGCTGGAGAAGGAGCCCATCATCGGCGCCGAGACCTTCTACGTGGAC
GGCGCCGCCAACCGCGAGACCAAGATCGGCAAGGCCGGCTACGTGACCGACCGGGGCCGGCAGAAGATC
GTGAGCCTGACCGAGACCACCAACCAGAAGACCGAGCTGCAGGCCATCCAGCTGGCCCTGCAGGACAGC
GGCAGCGAGGTGAACATCGTGACCGACAGCCAGTACGCCCTGGGCATCATCCAGGCCCAGCCCGACAAG
AGCGAGAGCGAGCTGGTGAACCAGATCATCGAGCAGCTGATCAAGAAGGAGAAGGTGTACCTGAGCTGG
GTGCCCGCCCACAAGGGCATCGGCGGCAACGAGCAGATCGACAAGCTGGTGAGCAAGGGCATCCGCAAG
GTGCTCGCTTAA
```

Figure 14A

GagProtInaRTmutTatRevNef_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAGAAAGAATTCCCCCAGATCACCCTGTGGCAGCGCCCC
CTGGTGAGCATCAAGGTGGGCGGCCAGATCAAGGAGGCCCTGCTGGCCACCGGCGCCGACGACACCGTG
CTGGAGGAGATGAGCCTGCCCGGCAAGTGGAAGCCCAAGATGATCGGCGGCATCGGCGGCTTCATCAAG
GTGCGCCAGTACGACCAGATCCTGATCGAGATCTGCGGCAAGAAGGCCATCGGCACCGTGCTGATCGGC
CCCACCCCCGTGAACATCATCGGCCGCAACATGCTGACCCAGCTGGGCTGCACCCTGAACTTCCCCATC
AGCCCCATCGAGACCGTGCCCGTGAAGCTGAAGCCCGGCATGGACGGCCCCAAGGTGAAGCAGTGGCCC
CTGACCGAGGAGAAGATCAAGGCCCTGACCGCCATCTGCGAGGAGATGGAGAAGGAGGGCAAGATCACC
AAGATCGGCCCCGAGAACCCCTACAACACCCCCGTGTTCGCCATCAAGAAGAAGGACAGCACCAAGTGG
CGCAAGCTGGTGGACTTCCGCGAGCTGAACAAGCGCACCCAGGACTTCTGGGAGGTGCAGCTGGGCATC
CCCCACCCCGCCGGCCTGAAGAAGAAGAAGAGCGTGACCGTGCTGGACGTGGGCGACGCCTACTTCAGC
GTGCCCCTGGACGAGGACTTCCGCAAGTACACCGCCTTCACCATCCCCAGCATCAACAACGAGACCCCC
GGCATCCGCTACCAGTACAACGTGCTGCCCCAGGGCTGGAAGGGCAGCCCCAGCATCTTCCAGAGCAGC
ATGACCAAGATCCTGGAGCCCTTCCGCGCCCGCAACCCCGAGATCGTGATCTACCAGGCCCCCCTGTAC
GTGGGCAGCGACCTGGAGATCGGCCAGCACCGCGCCAAGATCGAGGAGCTGCGCAAGCACCTGCTGCGC
TGGGGCTTCACCACCCCCGACAAGAAGCACCAGAAGGAGCCCCCCTTCCTGCCCATCGAGCTGCACCCC
GACAAGTGGACCGTGCAGCCCATCGAGCTGCCCGAGAAGGAGAGCTGGACCGTGAACGACATCCAGAAG
CTGGTGGGCAAGCTGAACTGGGCCAGCCAGATCTACCCCGGCATCAAGGTGCGCCAGCTGTGCAAGCTG
CTGCGCGGCGCCAAGGCCCTGACCGACATCGTGCCCCTGACCGAGGAGGCCGAGCTGGAGCTGGCCGAG
AACCGCGAGATCCTGCGCGAGCCCGTGCACGGCGTGTACTACGACCCCAGCAAGGACCTGGTGGCCGAG
ATCCAGAAGCAGGGCCACGACCAGTGGACCTACCAGATCTACCAGGAGCCCTTCAAGAACCTGAAGACC
GGCAAGTACGCCAAGATGCGCACCGCCCACACCAACGACGTGAAGCAGCTGACCGAGGCCGTGCAGAAG
ATCGCCATGGAGAGCATCGTGATCTGGGGCAAGACCCCCAAGTTCCGCCTGCCCATCCAGAAGGAGACC
TGGGAGACCTGGTGGACCGACTACTGGCAGGCCACCTGGATCCCCGAGTGGGAGTTCGTGAACACCCCC
CCCCTGGTGAAGCTGTGGTACCAGCTGGAGAAGGAGCCCATCATCGGCGCCGAGACCTTCTACGTGGAC
GGCGCCGCCAACCGCGAGACCAAGATCGGCAAGGCCGGCTACGTGACCGACCGGGGCCGGCAGAAGATC
GTGAGCCTGACCGAGACCACCAACCAGAAGACCGAGCTGCAGGCCATCCAGCTGGCCCTGCAGGACAGC
GGCAGCGAGGTGAACATCGTGACCGACAGCCAGTACGCCCTGGGCATCATCCAGGCCCAGCCCGACAAG
AGCGAGAGCGAGCTGGTGAACCAGATCATCGAGCAGCTGATCAAGAAGGAGAAGGTGTACCTGAGCTGG
GTGCCCGCCCACAAGGGCATCGGCGGCAACGAGCAGATCGACAAGCTGGTGAGCAAGGGCATCCGCAAG
GTGCTCaagcttGAGCCCGTGGACCCCAACCTGGAGCCCTGGAACCACCCCGGCAGCCAGCCCAAGACC
GCCGGCAACAAGTGCTACTGCAAGCACTGCAGCTACCACTGCCTGGTGAGCTTCCAGACCAAGGGCCTG
GGCATCAGCTACGGCCGCAAGAAGCGCCGCCAGCGCCGCAGCGCCCCCCCCAGCAGCGAGGACCACCAG
AACCCCATCAGCAAGCAGCCCCTGCCCCAGACCCGCGGCGACCCCACCGGCAGCGAGGAGAGCAAGAAG
AAGGTGGAGAGCAAGACCGAGACCGACCCCTTCGACCCCGGGGCCGGCCGCAGCGGCGACAGCGACGAG
GCCCTGCTGCAGGCCGTGCGCATCATCAAGATCCTGTACCAGAGCAACCCCTACCCCAAGCCCGAGGGC
```

Figure 14B

```
ACCCGCCAGGCCGACCTGAACCGCCGCCGCCGCTGGCGCGCCCGCCAGCGCCAGATCCACAGCATCAGC
GAGCGCATCCTGAGCACCTGCCTGGGCCGCCCCGCCGAGCCCGTGCCCTTCCAGCTGCCCCCCGACCTG
CGCCTGCACATCGACTGCAGCGAGAGCAGCGGCACCAGCGGCACCCAGCAGAGCCAGGGCACCACCGAG
GGCGTGGGCAGCCCCCTCGAGGCCGGCAAGTGGAGCAAGAGCAGCATCGTGGGCTGGCCCGCCGTGCGC
GAGCGCATCCGCCGCACCGAGCCCGCCGCCGAGGGCGTGGGCGCCGCCAGCCAGGACCTGGACAAGCAC
GGCGCCCTGACCAGCAGCAACACCGCCGCCAACAACGCCGACTGCGCCTGGCTGGAGGCCCAGGAGGAG
GAGGAGGAGGTGGGCTTCCCCGTGCGCCCCCAGGTGCCCCTGCGCCCCATGACCTACAAGGCCGCCTTC
GACCTGAGCTTCTTCCTGAAGGAGAAGGGCGGCCTGGAGGGCCTGATCTACAGCAAGAAGCGCCAGGAG
ATCCTGGACCTGTGGGTGTACCACACCCAGGGCTTCTTCCCCGGCTGGCAGAACTACACCCCCGGCCCC
GGCGTGCGCTACCCCCTGACCTTCGGCTGGTGCTTCAAGCTGGTGCCCGTGGACCCCGCGAGGTGGAG
GAGGCCAACAAGGGCGAGAACAACTGCCTGCTGCACCCCATGAGCCAGCACGGCATGGAGGACGAGGAC
CGCGAGGTGCTGAAGTGGAAGTTCGACAGCAGCCTGGCCCGCCGCCACATGGCCCGCGAGCTGCACCCC
GAGTACTACAAGGACTGCGCCTAA
```

Figure 15

GagRTmut_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAGAAAGAATTCCCCATCAGCCCCATCGAGACCGTGCCC
GTGAAGCTGAAGCCCGGCATGGACGGCCCCAAGGTGAAGCAGTGGCCCCTGACCGAGGAGAAGATCAAG
GCCCTGACCGCCATCTGCGAGGAGATGGAGAAGGAGGGCAAGATCACCAAGATCGGCCCCGAGAACCCC
TACAACACCCCCGTGTTCGCCATCAAGAAGAAGGACAGCACCAAGTGGCGCAAGCTGGTGGACTTCCGC
GAGCTGAACAAGCGCACCCAGGACTTCTGGGAGGTGCAGCTGGGCATCCCCCACCCCGCCGGCCTGAAG
AAGAAGAAGAGCGTGACCGTGCTGGACGTGGGCGACGCCTACTTCAGCGTGCCCCTGGACGAGGACTTC
CGCAAGTACACCGCCTTCACCATCCCCAGCATCAACAACGAGACCCCCGGCATCCGCTACCAGTACAAC
GTGCTGCCCCAGGGCTGGAAGGGCAGCCCCAGCATCTTCCAGAGCAGCATGACCAAGATCCTGGAGCCC
TTCCGCGCCCGCAACCCCGAGATCGTGATCTACCAGGCCCCCCTGTACGTGGGCAGCGACCTGGAGATC
GGCCAGCACCGCGCCAAGATCGAGGAGCTGCGCAAGCACCTGCTGCGCTGGGGCTTCACCACCCCCGAC
AAGAAGCACCAGAAGGAGCCCCCCTTCCTGCCCATCGAGCTGCACCCCGACAAGTGGACCGTGCAGCCC
ATCGAGCTGCCCGAGAAGGAGAGCTGGACCGTGAACGACATCCAGAAGCTGGTGGGCAAGCTGAACTGG
GCCAGCCAGATCTACCCCGGCATCAAGGTGCGCCAGCTGTGCAAGCTGCTGCGCGGCGCCAAGGCCCTG
ACCGACATCGTGCCCCTGACCGAGGAGGCCGAGCTGGAGCTGGCCGAGAACCGCGAGATCCTGCGCGAG
CCCGTGCACGGCGTGTACTACGACCCCAGCAAGGACCTGGTGGCCGAGATCCAGAAGCAGGGCCACGAC
CAGTGGACCTACCAGATCTACCAGGAGCCCTTCAAGAACCTGAAGACCGGCAAGTACGCCAAGATGCGC
ACCGCCCACACCAACGACGTGAAGCAGCTGACCGAGGCCGTGCAGAAGATCGCCATGGAGAGCATCGTG
ATCTGGGGCAAGACCCCCAAGTTCCGCCTGCCCATCCAGAAGGAGACCTGGGAGACCTGGTGGACCGAC
TACTGGCAGGCCACCTGGATCCCCGAGTGGGAGTTCGTGAACACCCCCCCCTGGTGAAGCTGTGGTAC
CAGCTGGAGAAGGAGCCCATCATCGGCGCCGAGACCTTCTACGTGGACGGCGCCGCCAACCGCGAGACC
AAGATCGGCAAGGCCGGCTACGTGACCGACCGGGCCGGCAGAAGATCGTGAGCCTGACCGAGACCACC
AACCAGAAGACCGAGCTGCAGGCCATCCAGCTGGCCCTGCAGGACAGCGGCAGCGAGGTGAACATCGTG
ACCGACAGCCAGTACGCCCTGGGCATCATCCAGGCCCAGCCCGACAAGAGCGAGAGCGAGCTGGTGAAC
CAGATCATCGAGCAGCTGATCAAGAAGGAGAAGGTGTACCTGAGCTGGGTGCCCGCCCACAAGGGCATC
GGCGGCAACGAGCAGATCGACAAGCTGGTGAGCAAGGGCATCCGCAAGGTGCTCTAA
```

Figure 16A

GagRTmutTatRevNef_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAGAAAGAATTCCCCATCAGCCCCATCGAGACCGTGCCC
GTGAAGCTGAAGCCCGGCATGGACGGCCCCAAGGTGAAGCAGTGGCCCCTGACCGAGGAGAAGATCAAG
GCCCTGACCGCCATCTGCGAGGAGATGGAGAAGGAGGGCAAGATCACCAAGATCGGCCCCGAGAACCCC
TACAACACCCCCGTGTTCGCCATCAAGAAGAAGGACAGCACCAAGTGGCGCAAGCTGGTGGACTTCCGC
GAGCTGAACAAGCGCACCCAGGACTTCTGGGAGGTGCAGCTGGGCATCCCCCACCCCGCCGGCCTGAAG
AAGAAGAAGAGCGTGACCGTGCTGGACGTGGGCGACGCCTACTTCAGCGTGCCCCTGGACGAGGACTTC
CGCAAGTACACCGCCTTCACCATCCCCAGCATCAACAACGAGACCCCCGGCATCCGCTACCAGTACAAC
GTGCTGCCCCAGGGCTGGAAGGGCAGCCCCAGCATCTTCCAGAGCAGCATGACCAAGATCCTGGAGCCC
TTCCGCGCCCGCAACCCCGAGATCGTGATCTACCAGGCCCCCCTGTACGTGGGCAGCGACCTGGAGATC
GGCCAGCACCGCGCCAAGATCGAGGAGCTGCGCAAGCACCTGCTGCGCTGGGGCTTCACCACCCCCGAC
AAGAAGCACCAGAAGGAGCCCCCCTTCCTGCCCATCGAGCTGCACCCCGACAAGTGGACCGTGCAGCCC
ATCGAGCTGCCCGAGAAGGAGAGCTGGACCGTGAACGACATCCAGAAGCTGGTGGGCAAGCTGAACTGG
GCCAGCCAGATCTACCCCGGCATCAAGGTGCGCCAGCTGTGCAAGCTGCTGCGCGGCGCCAAGGCCCTG
ACCGACATCGTGCCCCTGACCGAGGAGCCCGAGCTGGAGCTGGCCGAGAACCGCGAGATCCTGCGCGAG
CCCGTGCACGGCGTGTACTACGACCCCAGCAAGGACCTGGTGGCCGAGATCCAGAAGCAGGGCCACGAC
CAGTGGACCTACCAGATCTACCAGGAGCCCTTCAAGAACCTGAAGACCGGCAAGTACGCCAAGATGCGC
ACCGCCCACACCAACGACGTGAAGCAGCTGACCGAGGCCGTGCAGAAGATCGCCATGGAGAGCATCGTG
ATCTGGGGCAAGACCCCCAAGTTCCGCCTGCCCATCCAGAAGGAGACCTGGGAGACCTGGTGGACCGAC
TACTGGCAGGCCACCTGGATCCCCGAGTGGGAGTTCGTGAACACCCCCCCCCTGGTGAAGCTGTGGTAC
CAGCTGGAGAAGGAGCCCATCATCGGCGCCGAGACCTTCTACGTGGACGGCGCCGCCAACCGCGAGACC
AAGATCGGCAAGGCCGGCTACGTGACCGACCGGGGCCGGCAGAAGATCGTGAGCCTGACCGAGACCACC
AACCAGAAGACCGAGCTGCAGGCCATCCAGCTGGCCCTGCAGGACAGCGGCAGCGAGGTGAACATCGTG
ACCGACAGCCAGTACGCCCTGGGCATCATCCAGGCCCAGCCCGACAAGAGCGAGAGCGAGCTGGTGAAC
CAGATCATCGAGCAGCTGATCAAGAAGGAGAAGGTGTACCTGAGCTGGGTGCCCGCCCACAAGGGCATC
GGCGGCAACGAGCAGATCGACAAGCTGGTGAGCAAGGGCATCCGCAAGGTGCTCAAGCTTGAGCCCGTG
GACCCCAACCTGGAGCCCTGGAACCACCCCGGCAGCCAGCCCAAGACCGCCGGCAACAAGTGCTACTGC
AAGCACTGCAGCTACCACTGCCTGGTGAGCTTCCAGACCAAGGGCCTGGGCATCAGCTACGGCCGCAAG
AAGCGCCGCCAGCGCCGCAGCGCCCCCCCCAGCAGCGAGGACCACCAGAACCCCATCAGCAAGCAGCCC
CTGCCCCAGACCCGCGGCGACCCCACCGGCAGCGAGGAGAGCAAGAAGAAGGTGGAGAGCAAGACCGAG
ACCGACCCCTTCGACCCCGGGGCCGGCCGCAGCGGCGACAGCGACGAGGCCCTGCTGCAGGCCGTGCGC
ATCATCAAGATCCTGTACCAGAGCAACCCCTACCCCAAGCCCGAGGGCACCCGCCAGGCCGACCTGAAC
CGCCGCCGCCGCTGGCGCGCCCGCCAGCGCCAGATCCACAGCATCAGCGAGCGCATCCTGAGCACCTGC
CTGGGCCGCCCCGCCGAGCCCGTGCCCTTCCAGCTGCCCCCCGACCTGCGCCTGCACATCGACTGCAGC
GAGAGCAGCGGCACCAGCGGCACCCAGCAGAGCCAGGGCACCACCGAGGGCGTGGGCAGCCCCCTCGAG
```

Figure 16B

```
GCCGGCAAGTGGAGCAAGAGCAGCATCGTGGGCTGGCCCGCCGTGCGCGAGCGCATCCGCCGCACCGAG
CCCGCCGCCGAGGGCGTGGGCGCCGCCAGCCAGGACCTGGACAAGCACGGCGCCCTGACCAGCAGCAAC
ACCGCCGCCAACAACGCCGACTGCGCCTGGCTGGAGGCCCAGGAGGAGGAGGAGGAGGTGGGCTTCCCC
GTGCGCCCCCAGGTGCCCCTGCGCCCCATGACCTACAAGGCCGCCTTCGACCTGAGCTTCTTCCTGAAG
GAGAAGGGCGGCCTGGAGGGCCTGATCTACAGCAAGAAGCGCCAGGAGATCCTGGACCTGTGGGTGTAC
CACACCCAGGGCTTCTTCCCCGGCTGGCAGAACTACACCCCCGGCCCCGGCGTGCGCTACCCCCTGACC
TTCGGCTGGTGCTTCAAGCTGGTGCCCGTGGACCCCCGCGAGGTGGAGGAGGCCAACAAGGGCGAGAAC
AACTGCCTGCTGCACCCCATGAGCCAGCACGGCATGGAGGACGAGGACCGCGAGGTGCTGAAGTGGAAG
TTCGACAGCAGCCTGGCCCGCCGCCACATGGCCCGCGAGCTGCACCCCGAGTACTACAAGGACTGCGCC
TAA
```

GagTatRevNef_C

```
GCCACCATGGGCGCCCGCGCCAGCATCCTGCGCGGCGGCAAGCTGGACGCCTGGGAGCGCATCCGCCTG
CGCCCCGGCGGCAAGAAGTGCTACATGATGAAGCACCTGGTGTGGGCCAGCCGCGAGCTGGAGAAGTTC
GCCCTGAACCCCGGCCTGCTGGAGACCAGCGAGGGCTGCAAGCAGATCATCCGCCAGCTGCACCCCGCC
CTGCAGACCGGCAGCGAGGAGCTGAAGAGCCTGTTCAACACCGTGGCCACCCTGTACTGCGTGCACGAG
AAGATCGAGGTCCGCGACACCAAGGAGGCCCTGGACAAGATCGAGGAGGAGCAGAACAAGTGCCAGCAG
AAGATCCAGCAGGCCGAGGCCGCCGACAAGGGCAAGGTGAGCCAGAACTACCCCATCGTGCAGAACCTG
CAGGGCCAGATGGTGCACCAGGCCATCAGCCCCGCACCCTGAACGCCTGGGTGAAGGTGATCGAGGAG
AAGGCCTTCAGCCCCGAGGTGATCCCCATGTTCACCGCCCTGAGCGAGGGCGCCACCCCCCAGGACCTG
AACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAG
CCCCGCGGCAGCGACATCGCCGGCACCACCAGCACCCTGCAGGAGCAGATCGCCTGGATGACCAGCAAC
CCCCCCATCCCCGTGGGCGACATCTACAAGCGGTGGATCATCCTGGGCCTGAACAAGATCGTGCGGATG
TACAGCCCCGTGAGCATCCTGGACATCAAGCAGGGCCCCAAGGAGCCCTTCCGCGACTACGTGGACCGC
TTCTTCAAGACCCTGCGCGCCGAGCAGAGCACCCAGGAGGTGAAGAACTGGATGACCGACACCCTGCTG
GTGCAGAACGCCAACCCCGACTGCAAGACCATCCTGCGCGCTCTCGGCCCCGGCGCCAGCCTGGAGGAG
ATGATGACCGCCTGCCAGGGCGTGGGCGGCCCCAGCCACAAGGCCCGCGTGCTGGCCGAGGCGATGAGC
CAGGCCAACACCAGCGTGATGATGCAGAAGAGCAACTTCAAGGGCCCCCGGCGCATCGTCAAGTGCTTC
AACTGCGGCAAGGAGGGCCACATCGCCCGCAACTGCCGCGCCCCCGCAAGAAGGGCTGCTGGAAGTGC
GGCAAGGAGGGCCACCAGATGAAGGACTGCACCGAGCGCCAGGCCAACTTCCTGGGCAAGATCTGGCCC
AGCCACAAGGGCCGCCCCGGCAACTTCCTGCAGAGCCGCCCCGAGCCCACCGCCCCCCCGCCGAGAGC
TTCCGCTTCGAGGAGACCACCCCCGGCCAGAAGCAGGAGAGCAAGGACCGCGAGACCCTGACCAGCCTG
AAGAGCCTGTTCGGCAACGACCCCCTGAGCCAAGAATTCGAGCCCGTGGACCCCAACCTGGAGCCCTGG
AACCACCCCGGCAGCCAGCCCAAGACCGCCGGCAACAAGTGCTACTGCAAGCACTGCAGCTACCACTGC
CTGGTGAGCTTCCAGACCAAGGGCCTGGGCATCAGCTACGGCCGCAAGAAGCGCCGCCAGCGCCGCAGC
GCCCCCCCCAGCAGCGAGGACCACCAGAACCCCATCAGCAAGCAGCCCCTGCCCCAGACCCGCGGCGAC
CCCACCGGCAGCGAGGAGAGCAAGAAGAAGGTGGAGAGCAAGACCGAGACCGACCCCTTCGACCCCGGG
GCCGGCCGCAGCGGCGACAGCGACGAGGCCCTGCTGCAGGCCGTGCGCATCATCAAGATCCTGTACCAG
AGCAACCCCTACCCCAAGCCCGAGGGCACCCGCCAGGCCGACCTGAACCGCCGCCGCCGCTGGCGCGCC
CGCCAGCGCCAGATCCACAGCATCAGCGAGCGCATCCTGAGCACCTGCCTGGGCCGCCCCGCCGAGCCC
GTGCCCTTCCAGCTGCCCCCCGACCTGCGCCTGCACATCGACTGCAGCGAGAGCAGCGGCACCAGCGGC
ACCCAGCAGAGCCAGGGCACCACCGAGGGCGTGGGCAGCCCCCTCGAGGCCGGCAAGTGGAGCAAGAGC
AGCATCGTGGGCTGGCCCGCCGTGCGCGAGCGCATCCGCCGCACCGAGCCCGCCGCCGAGGGCGTGGGC
GCCGCCAGCCAGGACCTGGACAAGCACGGCGCCCTGACCAGCAGCAACACCGCCGCCAACAACGCCGAC
TGCGCCTGGCTGGAGGCCCAGGAGGAGGAGGAGGAGGTGGGCTTCCCCGTGCGCCCCCAGGTGCCCCTG
CGCCCCATGACCTACAAGGCCGCCTTCGACCTGAGCTTCTTCCTGAAGGAGAAGGGCGGCCTGGAGGGC
CTGATCTACAGCAAGAAGCGCCAGGAGATCCTGGACCTGTGGGTGTACCACACCCAGGGCTTCTTCCCC
GGCTGGCAGAACTACACCCCCGGCCCCGGCGTGCGCTACCCCCTGACCTTCGGCTGGTGCTTCAAGCTG
GTGCCCGTGGACCCCGCGAGGTGGAGGAGGCCAACAAGGGCGAGAACAACTGCCTGCTGCACCCCATG
AGCCAGCACGGCATGGAGGACGAGGACCGCGAGGTGCTGAAGTGGAAGTTCGACAGCAGCCTGGCCCGC
CGCCACATGGCCCGCGAGCTGCACCCCGAGTACTACAAGGACTGCGCCTAA
```

gp120mod.TV1.del118-210

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgggcgcc
 361 ggcgcctgcc ccaaggtgag cttcgacccc atccccatcc actactgcgc ccccgccggc
 421 tacgccatcc tgaagtgcaa caacaagacc ttcaacggca ccggcccctg ctacaacgtg
 481 agcaccgtgc agtgcaccca cggcatcaag cccgtggtga gcacccagct gctgctgaac
 541 ggcagcctgg ccgaggaggg catcatcatc gcagcgaga acctgaccga gaacaccaag
 601 accatcatcg tgcacctgaa cgagagcgtg gagatcaact gcacccgccc caacaacaac
 661 acccgcaaga gcgtgcgcat cggccccggc caggccttct acgccaccaa cgacgtgatc
 721 ggcaacatcc gccaggccca ctgcaacatc agcaccgacc gctggaacaa gaccctgcag
 781 caggtgatga gaagctgggg cgagcacttc cccaacaaga ccatccagtt caagccccac
 841 gccggcggcg acctggagat caccatgcac agcttcaact gccgcggcga gttcttctac
 901 tgcaacacca gcaacctgtt caacagcacc taccacagca acaacggcac ctacaagtac
 961 aacggcaaca gcagcagccc catcaccctg cagtgcaaga tcaagcagat cgtgcgcatg
1021 tggcagggcg tgggccaggc cacctacgcc ccccccatcg ccggcaacat cacctgccgc
1081 agcaacatca ccggcatcct gctgacccgc gacggcggct tcaacaccac caacaacacc
1141 gagaccttcc gccccggcgg cggcgacatg cgcgacaact ggcgcagcga gctgtacaag
1201 tacaaggtgg tggagatcaa gcccctgggc atcgccccca ccaaggccaa gcgccgcgtg
1261 gtgcagcgcg agaagcgcta a
```

gp120mod.TV1.delV1V2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgggcgc cggcaactgc aacaccagca ccatcaccca ggcctgcccc
 421 aaggtgagct tcgacccccat ccccatccac tactgcgccc cgccggcta cgccatcctg
 481 aagtgcaaca acaagacctt caacggcacc ggcccctgct acaacgtgag caccgtgcag
 541 tgcacccacg gcatcaagcc cgtggtgagc acccagctgc tgctgaacgg cagcctggcc
 601 gaggagggca tcatcatccg cagcgagaac ctgaccgaga cAccaagac catcatcgtg
 661 cacctgaacg agagcgtgga gatcaactgc acccgcccca caacaacac ccgcaagagc
 721 gtgcgcatcg gccccggcca ggccttctac gccaccaacg acgtgatcgg caacatccgc
 781 caggcccact gcaacatcag caccgaccgc tggaacaaga ccctgcagca ggtgatgaag
 841 aagctgggcg agcacttccc caacaagacc atccagttca gccccacgc cggcggcgac
 901 ctggagatca ccatgcacag cttcaactgc cgcggcgagt tcttctactg caccaccagc
 961 aacctgttca acagcaccta ccacagcaac aacggcacct acaagtacaa cggcaacagc
1021 agcagcccca tcaccctgca gtgcaagatc aagcagatcg tgcgcatgtg gcagggcgtg
1081 ggccaggcca cctacgcccc ccccatcgcc ggcaacatca cctgccgcag caacatcacc
1141 ggcatcctgc tgacccgcga cggcggcttc aacaccacca caacaccga gaccttccgc
1201 cccggcggcg gcgacatgcg cgacaactgg cgcagcgagc tgtacaagta caaggtggtg
1261 gagatcaagc ccctgggcat cgcccccacc aaggccaagc ccgcgtggt gcagcgcgag
1321 aagcgctaa
```

gp120mod.TV1.delV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc ctgatcaact gcaacaccag caccatcacc
 541 caggcctgcc ccaaggtgag cttcgacccc atccccatcc actactgcgc cccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca acaacggcac ctacaagtac
1141 aacggcaaca gcagcagccc catcaccctg cagtgcaaga tcaagcagat cgtgcgcatg
1201 tggcagggcg tgggccaggc cacctacgcc ccccccatcg ccggcaacat cacctgccgc
1261 agcaacatca ccggcatcct gctgacccgc gacggcggct tcaacaccac caacaacacc
1321 gagaccttcc gccccggcgg cggcgacatg cgcgacaact ggcgcagcga gctgtacaag
1381 tacaaggtgg tggagatcaa gcccctgggc atcgccccca ccaaggccaa gcgccgcgtg
1441 gtgcagcgcg agaagcgcta a
```

gp140mod.TV1.del118-210

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggcccaccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgggcgcc
 361 ggcgcctgcc ccaaggtgag cttcgacccc atccccatcc actactgcgc ccccgccggc
 421 tacgccatcc tgaagtgcaa caacaagacc ttcaacggca ccggcccctg ctacaacgtg
 481 agcaccgtgc agtgcaccca cggcatcaag cccgtggtga gcacccagct gctgctgaac
 541 ggcagcctgg ccgaggaggg catcatcatc cgcagcgaga acctgaccga gaacaccaag
 601 accatcatcg tgcacctgaa cgagagcgtg gagatcaact gcacccgccc caacaacaac
 661 acccgcaaga gcgtgcgcat cggccccggc caggccttct acgccaccaa cgacgtgatc
 721 ggcaacatcc gccaggccca ctgcaacatc agcaccgacc gctggaacaa gaccctgcag
 781 caggtgatga agaagctggg cgagcacttc cccaacaaga ccatccagtt caagccccac
 841 gccggcggcg acctggagat caccatgcac agcttcaact gccgcggcga gttcttctac
 901 tgcaacacca gcaacctgtt caacagcacc taccacagca acaacggcac ctacaagtac
 961 aacggcaaca gcagcagccc catcacactg cagtgcaaga tcaagcagat cgtgcgcatg
1021 tggcagggcg tgggccaggc cacctacgcc cccccatcg ccggcaacat cacctgccgc
1081 agcaacatca ccggcatcct gctgacccgc gacggcggct caacaccac caacaacacc
1141 gagaccttcc gccccggcgg cggcgacatg cgcgacaact ggcgcagcga gctgtacaag
1201 tacaaggtgg tggagatcaa gcccctgggc atcgccccca ccaaggccaa gcgccgcgtg
1261 gtgcagcgcg agaagcgcgc cgtgggcatc ggcgccgtgt tctgggctt cctgggcgcc
1321 gccggcagca ccatgggcgc cgccagcatc accctgaccg tgcaggcccg ccagctgctg
1381 agcggcatcg tgcagcagca gagcaacctg ctgaaggcca tcgaggccca gcagcacatg
1441 ctgcagctga ccgtgtgggg catcaagcag ctgcaggccc gcgtgctggc catcgagcgc
1501 tacctgaagg accagcagct gctgggcatc tggggctgca gcggccgcct gatctgcacc
1561 accgccgtgc cctggaacag cagctggagc aacaagagcg agaaggacat ctgggacaac
1621 atgacctgga tgcagtggga ccgcgagatc agcaactaca ccggcctgat ctacaacctg
1681 ctggaggaca gccagaacca gcaggagaag aacgagaagg acctgctgga gctggacaag
1741 tggaacaacc tgtggaactg gttcgacatc agcaactggc cctggtacat ctaa
```

gp140mod.TV1.delV1V2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgggcgc cggcaactgc aacaccagca ccatcaccca ggcctgcccc
 421 aaggtgagct tgaccccat ccccatccac tactgcgccc ccgccggcta cgccatcctg
 481 aagtgcaaca acaagacctt caacggcacc ggccctgct acaacgtgag caccgtgcag
 541 tgcacccacg gcatcaagcc cgtggtgagc acccagctgc tgctgaacgg cagcctggcc
 601 gaggagggca tcatcatccg cagcgagaac ctgaccgaga acaccaagac catcatcgtg
 661 cacctgaacg agagcgtgga gatcaactgc acccgcccca caacaacac ccgcaagagc
 721 gtgcgcatcg gccccggcca ggccttctac gccaccaacg acgtgatcgg caacatccgc
 781 caggcccact gcaacatcag caccgaccgc tggaacaaga ccctgcagca ggtgatgaag
 841 aagctgggcg agcacttccc caacaagacc atccagttca gccccacgc cggcggcgac
 901 ctggagatca ccatgcacag cttcaactgc cgcggcgagt tcttctactg caacaccagc
 961 aacctgttca acagcaccta ccacagcaac aacggcacct acaagtacaa cggcaacagc
1021 agcagcccca tcaccctgca gtgcaagatc aagcagatcg tgcgcatgtg gcagggcgtg
1081 ggccaggcca cctacgcccc ccccatcgcc ggcaacatca cctgccgcag caacatcacc
1141 ggcatcctgc tgacccgcga cggcggcttc aacaccacca caacaccga ccttccgc
1201 cccggcggcg gcgacatgcg cgacaactgg cgcagcgagc tgtacaagta caaggtggtg
1261 gagatcaagc ccctgggcat cgcccccacc aaggccaagc gccgcgtggt gcagcgcgag
1321 aagcgcgcg tgggcatcgg cgccgtgttc ctgggcttcc tgggcgccgc cggcagcacc
1381 atgggcgccg ccagcatcac cctgaccgtg caggccgcc agctgctgag cggcatcgtg
1441 cagcagcaga gcaacctgct gaaggccatc gaggcccagc agcacatgct gcagctgacc
1501 gtgtggggca tcaagcagct gcaggcccgc gtgctggcca tcgagcgcta cctgaaggac
1561 cagcagctgc tgggcatctg gggctgcagc ggccgcctga tctgcaccac cgccgtgccc
1621 tggaacagca gctggagcaa caagagcgag aaggacatct gggacaacat gacctggatg
1681 cagtgggacc gcgagatcag caactacacc ggcctgatct acaacctgct ggaggacagc
1741 cagaaccagc aggagaagaa cgagaaggac ctgctggagc tggacaagtg gaacaacctg
1801 tggaactggt tcgacatcag caactggccc tggtacatct aa
```

gp140mod.TV1.delV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc ctgatcaact gcaacaccag caccatcacc
 541 caggcctgcc ccaaggtgag cttcgacccc atccccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gacctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca caacggcac ctacaagtac
1141 aacggcaaca gcagcagccc catcacctg cagtgcaaga tcaagcagat cgtgcgcatg
1201 tggcagggcg tgggccaggc cacctacgcc ccccccatcg ccggcaacat cacctgccgc
1261 agcaacatca ccggcatcct gctgacccgc gacggcggct tcaacaccac caacaacacc
1321 gagaccttcc gccccggcgg cggcgacatg cgcgacaact ggcgcagcga gctgtacaag
1381 tacaaggtgg tggagatcaa gcccctgggc atcgccccca ccaaggccaa gcgccgcgtg
1441 gtgcagcgcg agaagcgcgc cgtgggcatc ggcgccgtgt tcctgggctt cctgggcgcc
1501 gccggcagca ccatgggcgc cgccagcatc accctgaccg tgcaggcccg ccagctgctg
1561 agcggcatcg tgcagcagca gagcaacctg ctgaaggcca tcgaggccca gcagcacatg
1621 ctgcagctga ccgtgtgggg catcaagcag ctgcaggccc gcgtgctggc catcgagcgc
1681 tacctgaagg accagcagct gctgggcatc tggggctgca gcggccgcct gatctgcacc
1741 accgccgtgc cctggaacag cagctggagc aacaagagcg agaaggacat ctgggacaac
1801 atgacctgga tgcagtggga ccgcgagatc agcaactaca ccggcctgat ctacaacctg
1861 ctggaggaca gccagaacca gcaggagaag aacgagaagg acctgctgga gctggacaag
1921 tggaacaacc tgtggaactg gttcgacatc agcaactggc cctggtacat ctaa
```

gp140mod.TV1.mut7

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccac caccgagctg cgcgacaaga gcacaagga gtacgccctg
 541 ttctaccgcc tggacatcgt gcccctgaac gagaacagcg acaacttcac ctaccgcctg
 601 atcaactgca acaccagcac catcacccag gcctgcccca aggtgagctt cgacccatc
 661 cccatccact actgcgcccc cgccggctac gccatcctga gtgcaacaa caagaccttc
 721 aacggcaccg gccctgcta acgtgagc accgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccaacga cgtgatcggc aacatccgcc aggcccactg caacatcagc
1021 accgaccgct ggaacaagac cctgcagcag gtgatgaaga gctgggcga gcacttcccc
1081 aacaagacca tccagttcaa gccccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagcccat cacctgcag
1261 tgcaagatca gcagatcgt gcgcatgtgg cagggcgtgg gccaggccac ctacgccccc
1321 cccatcgccg gcaacatcac ctgccgcagc aacatcaccg gcatcctgct gacccgcgac
1381 ggcggcttca acaccaccaa caacaccgag accttccgcc ccggcggcgg cgacatgcgc
1441 gacaactggc gcagcgagct gtacaagtac aaggtggtgg agatcaagcc cctgggcatc
1501 gcccccacca aggccatcag cagcgtggtg cagagcgaga gagcgccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtgggcat caagcagctg
1741 caggccgcg tgctggccat cgagcgctac ctgaaggacc agcagctgct gggcatctgg
1801 ggctgcagcg gccgcctgat ctgcaccacc gccgtgccct ggaacagcag ctggagcaac
1861 aagagcgaga aggacatctg gacaacatg acctggatgc agtgggaccg cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggcct ggtacatcta a
```

gp140mod.TV1.tpa2

```
   1 atggatgcaa tgaagagagg gctctgctgt gtgctgctgc tgtgtggagc agtcttcgtt
  61 tcgcccagca acaccgagga cctgtgggtg accgtgtact acggcgtgcc cgtgtggcgc
 121 gacgccaaga ccaccctgtt ctgcgccagc gacgccaagg cctacgagac cgaggtgcac
 181 aacgtgtggg ccaccacgc ctgcgtgccc accgacccca accccagga gatcgtgctg
 241 ggcaacgtga ccgagaactt caacatgtgg aagaacgaca tggccgacca gatgcacgag
 301 gacgtgatca gcctgtggga ccagagcctg aagccctgcg tgaagctgac ccccctgtgc
 361 gtgaccctga actgcaccga caccaacgtg accggcaacc gcaccgtgac cggcaacagc
 421 accaacaaca ccaacggcac cggcatctac aacatcgagg agatgaagaa ctgcagcttc
 481 aacgccacca ccgagctgcg cgacaagaag cacaaggagt acgccctgtt ctaccgcctg
 541 gacatcgtgc ccctgaacga aacagcgac aacttcacct accgcctgat caactgcaac
 601 accagcacca tcacccaggc ctgccccaag gtgagcttcg accccatccc catccactac
 661 tgcgcccccg ccggctacgc catcctgaag tgcaacaaca agaccttcaa cggcaccggc
 721 ccctgctaca acgtgagcac cgtgcagtgc acccacggca tcaagcccgt ggtgagcacc
 781 cagctgctgc tgaacggcag cctggccgag gagggcatca tcatccgcag cgagaacctg
 841 accgagaaca ccaagaccat catcgtgcac ctgaacgaga gcgtggagat caactgcacc
 901 cgccccaaca caacacccg caagagcgtg cgcatcggcc ccggccaggc cttctacgcc
 961 accaacgacg tgatcggcaa catccgccag gcccactgca acatcagcac cgaccgctgg
1021 aacaagaccc tgcagcaggt gatgaagaag ctgggcgagc acttccccaa caagaccatc
1081 cagttcaagc ccacgcggg cggcgacctg gagatcacca tgcacagctt caactgccgc
1141 ggcgagttct tctactgcaa caccagcaac ctgttcaaca gcacctacca cagcaacaac
1201 ggcacctaca agtacaacgg caacagcagc agccccatca ccctgcagtg caagatcaag
1261 cagatcgtgc gcatgtggca gggcgtgggc caggccacct acgcccccc catcgccggc
1321 aacatcacct gccgcagcaa catcaccggc atcctgctga cccgcgacgg cggcttcaac
1381 accaccaaca caccgagac cttccgcccc ggcggcggcg acatgcgcga caactggcgc
1441 agcgagctgt acaagtacaa ggtggtggag atcaagcccc tgggcatcgc ccccaccaag
1501 gccaagcgcc gcgtggtgca gcgcgagaag cgcgccgtgg catcggcgc cgtgttcctg
1561 ggcttcctgg gcgccgccgg cagcaccatg ggcgccgcca gcatcaccct gaccgtgcag
1621 gcccgccagc tgctgagcgg catcgtgcag cagcagagca cctgctgaa ggccatcgag
1681 gcccagcagc acatgctgca gctgaccgtg tgggcatca gcagctgca ggcccgcgtg
1741 ctggccatcg agcgctacct gaaggaccag cagctgctgg gcatctgggg ctgcagcggc
1801 cgcctgatct gcaccaccgc cgtgccctgg aacagcagct ggagcaacaa gagcgagaag
1861 gacatctggg acaacatgac ctggatgcag tgggaccgcg agatcagcaa ctacaccggc
1921 ctgatctaca ccctgctgga ggacagccag aaccagcagg agaagaacga gaaggacctg
1981 ctggagctgg acaagtggaa caacctgtgg aactggttcg acatcagcaa ctggccctgg
2041 tacatctaa
```

gp140.TM.mod.TV1

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccac caccgagctg cgcgacaaga agcacaagga gtacgccctg
 541 ttctaccgcc tggacatcgt gcccctgaac gagaacagcg acaacttcac ctaccgcctg
 601 atcaactgca acaccagcac catcacccag gcctgcccca aggtgagctt cgacccccatc
 661 cccatccact actgcgcccc cgccggctac gccatcctga agtgcaacaa caagaccttc
 721 aacggcaccg gcccctgcta caacgtgagc accgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccaacga cgtgatcggc aacatccgcc aggcccactg caacatcagc
1021 accgaccgct ggaacaagac cctgcagcag gtgatgaaga agctgggcga gcacttcccc
1081 aacaagacca tccagttcaa gccccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagccccat caccctgcag
1261 tgcaagatca agcagatcgt gcgcatgtgg cagggcgtgg gccaggccac ctacgccccc
1321 cccatcgccg gcaacatcac ctgccgcagc aacatcaccg gcatcctgct gacccgcgac
1381 ggcggcttca acaccaccaa caacaccgag accttccgcc ccggcggcgg cgacatgcgc
1441 gacaactggc gcagcgagct gtacaagtac aaggtggtgg agatcaagcc cctgggcatc
1501 gcccccacca aggccaagcg ccgcgtggtg cagcgcgaga agcgcgccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtggggcat caagcagctg
1741 caggcccgcg tgctggccat cgagcgctac ctgaaggacc agcagctgct gggcatctgg
1801 ggctgcagcg gccgcctgat ctgcaccacc gccgtgccct ggaacagcag ctggagcaac
1861 aagagcgaga aggacatctg ggacaacatg acctggatgc agtgggaccg cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggccct ggtacatcaa gatcttcatc atgatcgtgg gcggcctgat cggcctgcgc
2101 atcatcttcg ccgtgctgag catcgtg
```

gp160mod.TV1.del118-210

```
   1 atgcgcgtga tgggcaccca gaagaactgc cagcagtggt ggatctgggg catcctgggc
  61 ttctgg

gp160mod.TV1.delV1V2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggcccaccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgggcgc cggcaactgc aacaccagca ccatcaccca ggcctgcccc
 421 aaggtgagct tcgacccat ccccatccac tactgcgccc cgccggcta cgccatcctg
 481 aagtgcaaca caagaccttc aacggcaccg ggccctgct acaacgtgag caccgtgcag
 541 tgcacccacg gcatcaagcc cgtggtgagc accagctgc tgctgaacgg cagcctggcc
 601 gaggagggca tcatcatccg cagcgagaac ctgaccgaga acaccaagac catcatcgtg
 661 cacctgaacg agagcgtgga gatcaactgc acccgcccca caacaacac ccgcaagagc
 721 gtgcgcatcg gccccggcca ggccttctac gccaccaacg acgtgatcgg caacatccgc
 781 caggcccact gcaacatcag caccgaccgc tggaacaaga ccctgcagca ggtgatgaag
 841 aagctgggcg agcacttccc caacaagacc atccagttca gccccacgc cggcggcgac
 901 ctggagatca ccatgcacag cttcaactgc cgcggcgagt tcttctactg caacaccagc
 961 aacctgttca acagcaccta ccacagcaac aacggcacct acaagtacaa cggcaacagc
1021 agcagcccca tcaccctgca gtgcaagatc aagcagatcg tgcgcatgtg gcagggcgtg
1081 ggccaggcca cctacgcccc ccccatcgcc ggcaacatca cctgccgcag caacatcacc
1141 ggcatcctgc tgacccgcga cggcggcttc aacaccacca caacaccga ccttccgc
1201 cccggcggcg gcgacatgcg cgacaactgg cgcagcgagc tgtacaagta caaggtggtg
1261 gagatcaagc ccctgggcat cgcccccacc aaggccaagc gccgcgtggt gcagcgcgag
1321 aagcgcgccg tgggcatcgg cgccgtgttc ctgggcttcc tgggcgccgc cggcagcacc
1381 atgggcgccg ccagcatcac cctgaccgtg caggccgcc agctgctgag cggcatcgtg
1441 cagcagcaga gcaacctgct gaaggccatc gaggcccagc agcacatgct gcagctgacc
1501 gtgtgggca tcaagcagct gcaggcccgc gtgctggcca tcgagcgcta cctgaaggac
1561 cagcagctgc tgggcatctg gggctgcagc ggccgcctga tctgcaccac cgccgtgccc
1621 tggaacagca gctggagcaa caagagcgag aaggacatct ggacaacat gacctggatg
1681 cagtgggacc gcgagatcag caactacacc ggcctgatct acaacctgct ggaggacagc
1741 cagaaccagc aggagaagaa cgagaaggac ctgctggagc tggacaagtg gaacaacctg
1801 tggaactggt tcgacatcag caactggccc tggtacatct aa
```

gp160mod.TV1.delV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg gccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc ctgatcaact gcaacaccag caccatcacc
 541 caggcctgcc ccaaggtgag cttcgacccc atccccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga aacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca caacggcac ctacaagtac
1141 aacggcaaca gcagcagccc catcaccctg cagtgcaaga tcaagcagat cgtgcgcatg
1201 tggcagggcg tgggccaggc cacctacgcc cccccatcg ccgcaacat cacctgccgc
1261 agcaacatca ccggcatcct gctgacccgc gacggcggct caacaccac caacaacacc
1321 gagaccttcc gcccggcgg cggcgacatg cgcgacaact ggcgcagcga gctgtacaag
1381 tacaaggtgg tggagatcaa gccctggcc atcgccccca ccaaggccaa gcgccgcgtg
1441 gtgcagcgcg agaagcgcgc cgtgggcatc ggcgccgtgt tcctgggctt cctgggcgcc
1501 gccggcagca ccatgggcgc cgccagcatc accctgaccg tgcaggcccg ccagctgctg
1561 agcggcatcg tgcagcagca gagcaacctg ctgaaggcca tcgaggcca gcagcacatg
1621 ctgcagctga ccgtgtgggg catcaagcag ctgcaggccc gcgtgctggc catcgagcgc
1681 tacctgaagg accagcagct gctgggcatc tggggctgca gggccgcct gatctgcacc
1741 accgccgtgc cctggaacag cagctggagc aacaagagcg agaaggacat ctgggacaac
1801 atgacctgga tgcagtggga ccgcgagatc agcaactaca ccggcctgat ctacaacctg
1861 ctggaggaca gcagaacca gcaggagaag aacgagaagg acctgctgga gctggacaag
1921 tggaacaacc tgtggaactg gttcgacatc agcaactggc cctggtacat caagatcttc
1981 atcatgatcg tgggcggcct gatcggcctg cgcatcatct tcgccgtgct gagcatcgtg
2041 aaccgcgtgc gccaggcta cagccccctg agcttccaga ccctgacccc cagccccgc
2101 ggcctggacc gcctgggcgg catcgaggag gagggcggcg agcaggaccg cgaccgcagc
2161 atccgcctgg tgagcggctt cctgagcctg gcctgggacg acctgcgcaa cctgtgcctg
2221 ttcagctacc accgcctgcg cgacttcatc ctgatcgccg tgcgcgccgt ggagctgctg
2281 ggccacagca gcctgcgcgg cctgcagcgc ggctgggaga tcctgaagta cctgggcagc
2341 ctggtgcagt actgggccct ggagctgaag aagagcgcca tcagcctgct ggacaccatc
2401 gccatcaccg tggccgaggg caccgaccgc atcatcgagc tggtgcagcg catctgccgc
2461 gccatcctga acatcccccg ccgcatccgc cagggcttcg aggccgccct gctgtaa
```

gp160mod.TV1.dV1

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgggcgc cggcaactgc agcttcaacg ccaccaccga gctgcgcgac
 421 aagaagcaca aggagtacgc cctgttctac cgcctggaca tcgtgcccct gaacgagaac
 481 agcgacaact tcacctaccg cctgatcaac tgcaacacca gcaccatcac ccaggcctgc
 541 cccaaggtga gcttcgaccc catccccatc cactactgcg cccccgccgg ctacgccatc
 601 ctgaagtgca acaacaagac cttcaacggc accggcccct gctacaacgt gagcaccgtg
 661 cagtgcaccc acggcatcaa gcccgtggtg agcacccagc tgctgctgaa cggcagcctg
 721 gccgaggagg gcatcatcat ccgcagcgag aacctgaccg agaacaccaa gaccatcatc
 781 gtgcacctga acgagagcgt ggagatcaac tgcacccgcc caacaacaa cacccgcaag
 841 agcgtgcgca tggcccccgg ccaggccttc tacgccacca cgacgtgat cggcaacatc
 901 cgccaggccc actgcaacat cagcaccgac cgctggaaca agacctgca gcaggtgatg
 961 aagaagctgg gcgagcactt ccccaacaag accatccagt tcaagcccca cgccggcggc
1021 gacctggaga tcaccatgca cagcttcaac tgccgcggcg agttcttcta ctgcaacacc
1081 agcaacctgt tcaacagcac ctaccacagc aacaacggca cctacaagta caacggcaac
1141 agcagcagcc ccatcaccct gcagtgcaag atcaagcaga tgtgcgcat gtggcagggc
1201 gtgggccagg ccacctacgc cccccccatc gccggcaaca tcacctgccg cagcaacatc
1261 accggcatcc tgctgacccg cgacgcggc ttcaacacca ccaacaacac cgagaccttc
1321 cgccccggcg gcggcgacat gcgcgacaac tggcgcagcg agctgtacaa gtacaaggtg
1381 gtggagatca gcccctggg catcgccccc accaaggcca agcgccgcgt ggtgcagcgc
1441 gagaagcgcg ccgtgggcat cggcgccgtg ttcctgggct tcctgggcgc cgccggcagc
1501 accatgggcg ccgccagcat caccctgacc gtgcaggccg ccagctgct gagcggcatc
1561 gtgcagcagc agagcaacct gctgaaggcc atcgaggccc agcagcacat gctgcagctg
1621 accgtgtggg gcatcaagca gctgcaggcc cgcgtgctgg ccatcgagcg ctacctgaag
1681 gaccagcagc tgctgggcat ctgggctgc agcggccgcc tgatctgcac caccgccgtg
1741 ccctggaaca gcagctggag caacaagagc gagaaggaca tctgggacaa catgacctgg
1801 atgcagtggg accgcgagat cagcaactac accggcctga tctacaacct gctggaggac
1861 agccagaacc agcaggagaa gaacgagaag gacctgctgg agctggacaa gtggaacaac
1921 ctgtggaact ggttcgacat cagcaactgg ccctggtaca tcaagatctt catcatgatc
1981 gtgggcggcc tgatcggcct gcgcatcatc ttcgccgtgc tgagcatcgt gaaccgcgtg
2041 cgccagggct acagccccct gagcttccag acctgaccc ccagccccg cggcctggac
2101 cgcctgggcg gcatcgagga ggagggcggc gagcaggacc gcgaccgcag catccgcctg
2161 gtgagcggct tcctgagcct ggcctggac gacctgcgca acctgtgcct gttcagctac
2221 caccgcctgc gcgacttcat cctgatcgcc gtgcgcgccg tggagctgct gggccacagc
2281 agcctgcgcg gcctgcagcg cggctggag atcctgaagt acctgggcag cctggtgcag
2341 tactggggcc tggagctgaa gaagagcgcc atcagcctgc tggacaccat cgccatcacc
2401 gtggccgagg gcaccgaccg catcatcgag ctggtcagc gcatctgccg cgccatcctg
2461 aacatccccc gccgcatccg ccagggcttc gaggccgccc tgctgtaa
```

Figure 31A gp160mod.TV1.dV1-gagmod.BW965

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg gccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgggcgc cggcaactgc agcttcaacg ccaccaccga gctgcgcgac
 421 aagaagcaca aggagtacgc cctgttctac cgcctggaca tcgtgcccct gaacgagaac
 481 agcgacaact tcacctaccg cctgatcaac tgcaacacca gcaccatcac ccaggcctgc
 541 cccaaggtga gcttcgaccc catccccatc cactactgcg ccccgccgg ctacgccatc
 601 ctgaagtgca acaacaagac cttcaacggc accggcccct gctacaacgt gagcaccgtg
 661 cagtgcaccc acggcatcaa gcccgtggtg agcacccagc tgctgctgaa cggcagcctg
 721 gccgaggagg gcatcatcat ccgcagcgag aacctgaccg agaacaccaa gaccatcatc
 781 gtgcacctga cagagcgt ggagatcaac tgcacccgcc caacaacaa cacccgcaag
 841 agcgtgcgca tcggccccgg ccaggccttc tacgccacca cgacgtgat cggcaacatc
 901 cgccaggccc actgcaacat cagcaccgac cgctggaaca gaccctgca gcaggtgatg
 961 aagaagctgg cgagcactt ccccaacaag accatccagt tcaagcccca cgccggcggc
1021 gacctggaga tcaccatgca cagcttcaac tgccgcggcg agttcttcta ctgcaacacc
1081 agcaacctgt tcaacagcac ctaccacagc aacaacggca cctacaagta acggcaac
1141 agcagcagcc catcaccct gcagtgcaag atcaagcaga tcgtgcgcat gtggcagggc
1201 gtgggccagg ccacctacgc ccccccatc gccggcaaca tcacctgccg cagcaacatc
1261 accggcatcc tgctgacccg cgacggcggc ttcaacacca caacaacac cgagaccttc
1321 cgccccggcg gcggcgacat gcgcgacaac tggcgcagcg agctgtacaa gtacaaggtg
1381 gtggagatca gcccctggg catcgccccc accaaggcca agcgccgcgt ggtgcagcgc
1441 gagaagcgcg ccgtgggcat cggcgccgtg ttcctgggct tcctgggcgc cgccggcagc
1501 accatgggcg ccgccagcat caccctgacc gtgcaggccc gccagctgct gagcggcatc
1561 gtgcagcagc agagcaacct gctgaaggcc atcgaggccc agcagcacat gctgcagctg
1621 accgtgtggg gcatcaagca gctgcaggcc cgcgtgctgg ccatcgagcg ctacctgaag
1681 gaccagcagc tgctgggcat ctggggctgc agcggccgcc tgatctgcac caccgccgtg
1741 ccctggaaca gcagctggag caacaagagc gagaaggaca tctgggacaa catgacctgg
1801 atgcagtggg accgcgagat cagcaactac accggcctga tctacaacct gctggaggac
1861 agccagaacc agcaggagaa gaacgagaag gacctgctgg agctggacaa gtggaacaac
1921 ctgtggaact ggttcgacat cagcaactgg ccctggtaca tcaagatctt catcatgatc
1981 gtgggcggcc tgatcggcct gcgcatcatc ttccgcgtgc tgagcatcgt gaaccgcgtg
2041 cgccagggct acagccccct gagcttccag accctgaccc ccagccccg cggcctggac
2101 cgcctgggcg catcgagga ggagggcggc gagcaggacc gcgaccgcag catccgcctg
2161 gtgagcggct tcctgagcct ggcctggac gacctgcgca acctgtgcct gttcagctac
2221 caccgcctgc gcgacttcat cctgatcgcc gtgcgcgccg tggagctgct gggccacagc
2281 agcctgcgcg gcctgcagcg cggctggag atcctgaagt acctgggcag cctggtgcag
2341 tactggggcc tggagctgaa gaagagcgcc atcagcctgc tggacaccat cgccatcacc
2401 gtggccgagg gcaccgaccg catcatcgag ctggtgcagc gcatctgccg cgccatcctg
2461 aacatccccc gccgcatccg ccagggcttc gaggccgccc tgctgtaact cgagcaagtc
2521 tagagggaga ccacaacggt ttccctctag cgggatcaat tccgccccc ccctaacgt
2581 tactggccga agccgcttgg aataaggccg gtgtgcgttt gtctatatgt tattttccac
2641 catattgccg tcttttggca atgtgagggc ccggaaacct ggccctgtct tcttgacgag
2701 cattcctagg ggtctttccc ctctcgccaa aggaatgcaa ggtctgttga atgtcgtgaa
2761 ggaagcagtt cctctggaag cttcttgaag acaaacaacg tctgtagcga ccctttgcag
2821 gcagcggaac cccccacctg gcgacaggtg cctctgcggc aaaagccac gtgtataaga
2881 tacacctgca aaggcggcac aaccccagtg ccacgttgtg agttggatag ttgtggaaag
2941 agtcaaatgg ctctcctcaa gcgtattcaa caggggctg aaggatgccc agaaggtacc
3001 ccattgtatg ggatctgatc tggggcctcg gtgcacatgc tttacatgt tttagtcgag
3061 gttaaaaaac gtctaggccc ccgaaccac ggggacgtgg ttttcctttg aaaaacacga
3121 taataccatg ggcgcccgcg ccagcatcct gcgcggcggc aagctggacg cctgggagcg
3181 catccgcctg cgcccggcg gcaagaagtg ctacatgatg aagcacctgg tgtgggccag
3241 ccgcgagctg gagaagttcg ccctgaaccc cggcctgctg gagaccagcg agggctgcaa
3301 gcagatcatc cgccagctgc accccgccct gcagaccggc agcgaggagc tgaagagcct
```

Figure 31B

```
3361 gttcaacacc gtggccaccc tgtactgcgt gcacgagaag atcgaggtcc gcgacaccaa
3421 ggaggccctg gacaagatcg aggaggagca gaacaagtgc cagcagaaga tccagcaggc
3481 cgaggccgcc gacaagggca aggtgagcca gaactacccc atcgtgcaga acctgcaggg
3541 ccagatggtg caccaggcca tcagcccccg caccctgaac gcctgggtga aggtgatcga
3601 ggagaaggcc ttcagccccg aggtgatccc catgttcacc gccctgagcg agggcgccac
3661 cccccaggac ctgaacacga tgttgaacac cgtgggcggc caccaggccg ccatgcagat
3721 gctgaaggac accatcaacg aggaggccgc cgagtgggac cgcgtgcacc ccgtgcacgc
3781 cggccccatc gccccggcc agatgcgcga gccccgcggc agcgacatcg ccggcaccac
3841 cagcaccctg caggagcaga tcgcctggat gaccagcaac ccccccatcc ccgtgggcga
3901 catctacaag cggtggatca tcctgggcct gaacaagatc gtgcggatgt acagccccgt
3961 gagcatcctg gacatcaagc agggccccaa ggagcccttc cgcgactacg tggaccgctt
4021 cttcaagacc ctgcgcgccg agcagagcac ccaggaggtg aagaactgga tgaccgacac
4081 cctgctggtg cagaacgcca accccgactg caagaccatc ctgcgcgctc tcggccccgg
4141 cgccagcctg gaggagatga tgaccgcctg ccagggcgtg ggcggcccca gccacaaggc
4201 ccgcgtgctg gccgaggcga tgagccaggc caacaccagc gtgatgatgc agaagagcaa
4261 cttcaagggc ccccggcgca tcgtcaagtg cttcaactgc ggcaaggagg ccacatcgc
4321 ccgcaactgc cgcgcccccc gcaagaaggg ctgctggaag tgcggcaagg agggccacca
4381 gatgaaggac tgcaccgagc gccaggccaa cttcctgggc aagatctggc cagccacaa
4441 gggccgcccc ggcaacttcc tgcagagccg ccccgagccc accgccccccc ccgccgagag
4501 cttccgcttc gaggagacca ccccggcca gaagcaggag agcaaggacc gcgagaccct
4561 gaccagcctg aagagcctgt cggcaacga ccccctgagc caataa
```

Figure 32A gp160mod.TV1.dV1V2-gagmod.BW965

```
   1 atgcgcgtga tgggcaccca aagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgggcgc cggcaactgc aacaccagca ccatcaccca ggcctgcccc
 421 aaggtgagct tcgaccccat ccccatccac tactgcgccc cgccggcta cgccatcctg
 481 aagtgcaaca acaagacctt caacggcacc ggccctgct acaacgtgag caccgtgcag
 541 tgcacccacg gcatcaagcc cgtggtgagc acccagctgc tgctgaacgg cagcctggcc
 601 gaggagggca tcatcatccg cagcgagaac ctgaccgaga acaccaagac catcatcgtg
 661 cacctgaacg agagcgtgga gatcaactgc acccgcccca acaacaacac ccgcaagagc
 721 gtgcgcatcg gccccggcca ggccttctac gccaccaacg acgtgatcgg caacatccgc
 781 caggcccact gcaacatcag caccgaccgc tggaacaaga ccctgcagca ggtgatgaag
 841 aagctgggca gcacttccc caacaagacc atccagttca gccccacgc cggcggcgac
 901 ctggagatca ccatgcacag cttcaactgc cgcggcgagt tcttctactg caacaccagc
 961 aacctgttca acagcaccta ccacagcaac aacggcacct acaagtacaa cggcaacagc
1021 agcagcccca tcaccctgca gtgcaagatc aagcagatcg tgcgcatgtg gcagggcgtg
1081 ggccaggcca cctacgcccc ccccatcgcc ggcaacatca cctgccgcag caacatcacc
1141 ggcatcctgc tgacccgcga cggcggcttc aacaccacca caacaccga ccttccgc
1201 cccggcggcg gcgacatgcg cgacaactgg cgcagcgagc tgtacaagta caaggtggtg
1261 gagatcaagc ccctgggcat cgccccacc aaggccaagc gccgcgtggt gcagcgcgag
1321 aagcgcgccg tgggcatcgg cgccgtgttc ctgggcttcc tgggcgccgc cggcagcacc
1381 atgggcgccg ccagcatcac cctgaccgtg caggcccgcc agctgctgag cggcatcgtg
1441 cagcagcaga gcaacctgct gaaggccatc gaggcccagc agcacatgct gcagctgacc
1501 gtgtgggca tcaagcagct gcaggcccgc gtgctggcca tcgagcgcta cctgaaggac
1561 cagcagctgc tgggcatctg gggctgcagc ggccgcctga tctgcaccac cgccgtgccc
1621 tggaacagca gctggagcaa caagagcgag aaggacatct gggacaacat gacctggatg
1681 cagtgggacc gcgagatcag caactacacc ggcctgatct acaacctgct ggaggacagc
1741 cagaaccagc aggagaagaa cgagaaggac ctgctggagc tggacaagtg gaacaacctg
1801 tggaactggt tcgacatcag caactggccc tggtacatca agatcttcat catgatcgtg
1861 ggcggcctga tcggcctgcg catcatcttc gccgtgctga gcatcgtgaa ccgcgtgcgc
1921 cagggctaca gccccctgag cttccagacc ctgacccca gccccgcgg cctggaccgc
1981 ctgggcggca tcgaggagga gggcggcgag caggaccgcg accgcagcat ccgcctggtg
2041 agcggcttcc tgagcctggc ctgggacgac ctgcgcaacc tgtgcctgtt cagctaccac
2101 cgcctgcgcg acttcatcct gatcgccgtg cgcgccgtgg agctgctggg ccacagcagc
2161 ctgcgcgcc tgcagcgcgg ctgggagatc ctgaagtacc tgggcagcct ggtgcagtac
2221 tggggcctgg agctgaagaa gagcgccatc agcctgctgg acaccatcgc catcaccgtg
2281 gccgagggca ccgaccgcat catcgagctg gtgcagcgca tctgccgcgc catcctgaac
2341 atcccccgcc gcatccgcca gggcttcgag gccgccctgc tgtaactcga gcaagtctag
2401 agggagacca acggtttc cctctagcgg atcaattcc gcccccccc ctaacgttac
2461 tggccgaagc cgcttggaat aaggccggtg tgcgtttgtc tatatgttat tttccaccat
2521 attgccgtct tttggcaatg tgagggcccg gaaacctggc cctgtcttct tgacgagcat
2581 tcctagggt cttttccctc tcgccaaagg aatgcaaggt ctgttaatg tcgtgaagga
2641 agcagttcct ctggaagctt cttgaagaca acaacgtct gtagcgaccc tttgcaggca
2701 gcggaacccc ccacctggcg acaggtgcct ctgcggccaa aagccacgtg tataagatac
2761 acctgcaaag gcggcacaac cccagtgcca cgttgtgagt tggatagttg tggaaagagt
2821 caaatggctc tcctcaagcg tattcaacaa ggggctgaag gatgcccaga aggtaccca
2881 ttgtatggga tctgatctgg ggcctcggtg cacatgcttt acatgtgttt agtcgaggtt
2941 aaaaacgtc tagggccccc gaaccacggg gacgtggttt tcctttgaaa aacacgataa
3001 taccatgggc gccgcgcca gcatcctgcg cggcggcaag ctggacgcct gggagcgcat
3061 ccgcctgcgc cccggcggca agaagtgcta catgatgaag cacctggtgt gggccagccg
3121 cgagctggag aagttcgccc tgaaccccgg cctgctggag accagcgagg gctgcaagca
3181 gatcatccgc cagctgcacc ccgccctgca gaccggcagc gaggagctga gagcctgtt
3241 caacaccgtg gccaccctgt actgcgtgca cgagaagatc gaggtccgcg acaccaagga
```

Figure 32B

```
3301 ggccctggac aagatcgagg aggagcagaa caagtgccag cagaagatcc agcaggccga
3361 ggccgccgac aagggcaagg tgagccagaa ctaccccatc gtgcagaacc tgcagggcca
3421 gatggtgcac caggccatca gcccccgcac cctgaacgcc tgggtgaagg tgatcgagga
3481 gaaggccttc agccccgagg tgatccccat gttcaccgcc ctgagcgagg gcgccacccc
3541 ccaggacctg aacacgatgt tgaacaccgt gggcggccac caggccgcca tgcagatgct
3601 gaaggacacc atcaacgagg aggccgccga gtgggaccgc gtgcaccccg tgcacgccgg
3661 ccccatcgcc cccggccaga tgcgcgagcc ccgcggcagc gacatcgccg gcaccaccag
3721 caccctgcag gagcagatcg cctggatgac cagcaacccc cccatccccg tgggcgacat
3781 ctacaagcgg tggatcatcc tgggcctgaa caagatcgtg cggatgtaca gccccgtgag
3841 catcctggac atcaagcagg gccccaagga gcccttccgc gactacgtgg accgcttctt
3901 caagaccctg cgcgccgagc agagcaccca ggaggtgaag aactggatga ccgacaccct
3961 gctggtgcag aacgccaacc ccgactgcaa gaccatcctg cgcgctctcg gccccggcgc
4021 cagcctggag gagatgatga ccgcctgcca gggcgtgggc ggcccagcc acaaggcccg
4081 cgtgctggcc gaggcgatga gccaggccaa caccagcgtg atgatgcaga gagcaactt
4141 caagggcccc cggcgcatcg tcaagtgctt caactgcggc aaggagggcc acatcgccc
4201 caactgccgc gccccccgca agaagggctg ctggaagtgc ggcaaggagg gccaccagat
4261 gaaggactgc accgagcgcc aggccaactt cctgggcaag atctggccca gccacaaggg
4321 ccgccccggc aacttcctgc agagccgccc cgagcccacc gcccccccg ccgagagctt
4381 ccgcttcgag gagaccaccc ccggcagaa gcaggagagc aaggaccgcg agaccctgac
4441 cagcctgaag agcctgttcg gcaacgaccc cctgagccaa taa
```

Figure 33A

```
gp160mod.TV1.dV2-gagmod.BW965

1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccgccaa ccgcaccgtg
 421 accggcaaca gcaccaacaa caccagcacc accggcatct acaacatcga ggagatgaag
 481 aactgcagct tcaacgccgg cgccggccgc ctgatcaact gcaacaccag caccatcacc
 541 caggcctgcc ccaaggtgag cttcgacccc atccccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca acaacggcac ctacaagtac
1141 aacggcaaca gcagcagccc catcaccctg cagtgcaaga tcaagcagat cgtgcgcatg
1201 tggcagggcg tgggccaggc cacctacgcc ccccccatcg ccggcaacat cacctgccgc
1261 agcaacatca ccggcatcct gctgacccgc gacggcggct tcaacaccac caacaacacc
1321 gagaccttcc gccccggcgg cggcgacatg cgcgacaact ggcgcagcga gctgtacaag
1381 tacaaggtgg tggagatcaa gcccctgggc atcgccccca ccaaggccaa gcgccgcgtg
1441 gtgcagcgcg agaagcgcgc cgtgggcatc ggcgccgtgt tcctgggctt cctgggcgcc
1501 gccggcagca ccatgggcgc cgccagccc accctgaccg tgcaggcccg ccagctgctg
1561 agcggcatcg tgcagcagca gagcaacctg ctgaaggcca tcgaggccca gcagcacatg
1621 ctgcagctga ccgtgtgggg catcaagcag ctgcaggccc gcgtgctggc catcgagcgc
1681 tacctgaagg accagcagct gctgggcatc tggggctgca gcggccgcct gatctgcacc
1741 accgccgtgc cctggaacag cagctggagc aacaagagcg agaaggacat ctgggacaac
1801 atgacctgga tgcagtggga ccgcgagatc agcaactaca ccggcctgat ctacaacctg
1861 ctggaggaca gccagaacca gcaggagaag aacgagaagg acctgctgga gctggacaag
1921 tggaacaacc tgtggaactg gttcgacatc agcaactggc cctggtacat caagatcttc
1981 atcatgatcg tgggcggcct gatcggcctg cgcatcatct tcgccgtgct gagcatcgtg
2041 aaccgcgtgc gccagggcta cagccccctg agcttccaga ccctgacccc cagccccgc
2101 ggcctggacc gcctgggcgg catcgaggag gagggcggcg agcaggaccg cgaccgcagc
2161 atccgcctgg tgagcggctt cctgagcctg gcctgggacg acctgcgcaa cctgtgcctg
2221 ttcagctacc accgcctgcg cgacttcatc ctgatcgccg tgcgcgccgt ggagctgctg
2281 ggccacagca gcctgcgcgg cctgcagcgc ggctgggaga tcctgaagta cctgggcagc
2341 ctggtgcagt actgggcct ggagctgaag aagagcgcca tcagcctgct ggacaccatc
2401 gccatcaccg tggccgaggg caccgaccgc atcatcgagc tggtgcagcg catctgccgc
2461 gccatcctga acatccccg ccgcatccgc cagggcttcg aggccgccct gctgtaactc
2521 gagcaagtct agagggagac cacaacggtt tccctctage gggatcaatt ccgccccccc
2581 ccctaacgtt actggccgaa gccgcttgga ataaggccgg tgtgcgtttg tctatatgtt
2641 attttccacc atattgccgt cttttggcaa tgtgagggcc cggaaacctg gccctgtctt
2701 cttgacgagc attcctaggg gtctttcccc tctcgccaaa ggaatgcaag gtctgttgaa
2761 tgtcgtgaag aagcagttc ctctggaagc ttcttgaaga caacaacgt ctgtagcgac
2821 cctttgcagg cagcggaacc ccccacctgg cgacaggtgc ctctgcggcc aaaagccacg
2881 tgtataagat acacctgcaa aggcggcaca accccagtgc cacgttgtga gttggatagt
2941 tgtggaaaga gtcaaatggc tctcctcaag cgtattcaac aaggggctga aggatgccca
3001 gaaggtaccc cattgtatgg gatctgatct ggggcctcgg tgcacatgct ttacatgtgt
3061 ttagtcgagg ttaaaaaacg tctaggcccc ccgaaccacg gggacgtggt tttcctttga
3121 aaaacacgat aataccatgg gcgcccgcgc cagcatcctg cgcggcggca gctggacgc
3181 ctgggagcgc atccgcctgc gccccggcgg caagaagtgc tacatgatga gcacctggt
3241 gtgggccagc cgcgagctgg agaagttcgc cctgaacccc ggcctgctgg agaccagcga
```

Figure 33B

```
3301 gggctgcaag cagatcatcc gccagctgca ccccgccctg cagaccggca gcgaggagct
3361 gaagagcctg ttcaacaccg tggccaccct gtactgcgtg cacgagaaga tcgaggtccg
3421 cgacaccaag gaggccctgg acaagatcga ggaggagcag aacaagtgcc agcagaagat
3481 ccagcaggcc gaggccgccg acaagggcaa ggtgagccag aactacccca tcgtgcagaa
3541 cctgcagggc cagatggtgc accaggccat cagcccccgc accctgaacg cctgggtgaa
3601 ggtgatcgag gagaaggcct tcagccccga ggtgatcccc atgttcaccg ccctgagcga
3661 gggcgccacc ccccaggacc tgaacacgat gttgaacacc gtgggcggcc accaggccgc
3721 catgcagatg ctgaaggaca ccatcaacga ggaggccgcc gagtgggacc gcgtgcaccc
3781 cgtgcacgcc ggccccatcg ccccggcca gatgcgcgag ccccgcggca gcgacatcgc
3841 cggcaccacc agcaccctgc aggagcagat cgcctggatg accagcaacc cccccatccc
3901 cgtgggcgac atctacaagc ggtggatcat cctgggcctg aacaagatcg tgcggatgta
3961 cagccccgtg agcatcctgg acatcaagca gggccccaag gagcccttcc gcgactacgt
4021 ggaccgcttc ttcaagaccc tgcgcgccga gcagagcacc caggaggtga agaactggat
4081 gaccgacacc ctgctggtgc agaacgccaa ccccgactgc aagaccatcc tgcgcgctct
4141 cggccccggc gccagcctgg aggagatgat gaccgcctgc agggcgtgg gcggccccag
4201 ccacaaggcc cgcgtgctgg ccgaggcgat gagccaggcc aacaccagcg tgatgatgca
4261 gaagagcaac ttcaagggcc ccggcgcat cgtcaagtgc ttcaactgcg gcaaggaggg
4321 ccacatcgcc cgcaactgcc gcgccccccg caagaaggc tgctggaagt gcggcaagga
4381 gggccaccag atgaaggact gcaccgagcg ccaggccaac ttcctgggca agatctggcc
4441 cagccacaag ggccgccccg gcaacttcct gcagagccgc cccgagccca ccgcccccc
4501 cgccgagagc ttccgcttcg aggagaccac ccccggccag aagcaggaga gcaaggaccg
4561 cgagaccctg accagcctga gagcctgtt cggcaacgac cccctgagcc aataa
```

gp160mod.TV1.tpa2

```
   1 atggatgcaa tgaagagagg gctctgctgt gtgctgctgc tgtgtggagc agtcttcgtt
  61 tcgcccagca acaccgagga cctgtgggtg accgtgtact acggcgtgcc cgtgtggcgc
 121 gacgccaaga ccaccctgtt ctgcgccagc gacgccaagg cctacgagac cgaggtgcac
 181 aacgtgtggg ccacccacgc ctgcgtgccc accgacccca accccagga gatcgtgctg
 241 ggcaacgtga ccgagaactt caacatgtgg aagaacgaca tggccgacca gatgcacgag
 301 gacgtgatca gcctgtggga ccagagcctg aagccctgcg tgaagctgac cccctgtgc
 361 gtgaccctga actgccga caccaacgtg accggcaacc gcaccgtgac cggcaacagc
 421 accaacaaca ccaacggcac cggcatctac aacatcgagg agatgaagaa ctgcagcttc
 481 aacgccacca ccgagctgcg cgacaagaag cacaaggagt acgccctgtt ctaccgcctg
 541 gacatcgtgc cctgaacga aacagcgac aacttcacct accgcctgat caactgcaac
 601 accagcacca tcacccaggc ctgcccaag gtgagcttcg accccatccc catccactac
 661 tgcgccccg ccggctacgc catcctgaag tgcaacaaca agaccttcaa cggcaccggc
 721 ccctgctaca acgtgagcac cgtgcagtgc acccacggca tcaagcccgt ggtgagcacc
 781 cagctgctgc tgaacggcag cctggccgag gagggcatca tcatccgcag cgagaacctg
 841 accgagaaca ccaagaccat catcgtgcac ctgaacgaga gcgtggagat caactgcacc
 901 cgccccaaca acaacacccg caagagcgtg cgcatcggcc cggccaggc cttctacgcc
 961 accaacgacg tgatcggcaa catccgccag gccactgca acatcagcac gaccgctgg
1021 aacaagaccc tgcagcaggt gatgaagaag ctgggcgagc acttccccaa caagaccatc
1081 cagttcaagc cccacgccgg cggcgacctg gagatcacca tgcacagctt caactgccgc
1141 ggcgagttct ctactgcaa caccagcaac ctgttcaaca gcacctacca gcaacaac
1201 ggcacctaca agtacaacgg caacagcagc agcccatca cctgcagtg caagatcaag
1261 cagatcgtgc gcatgtggca gggcgtgggc caggccacct acgccccccc catcgccggc
1321 aacatcacct gccgcagcaa catcaccggc atcctgctga cccgcgacgg cggcttcaac
1381 accaccaaca caccgagac cttccgcccc ggcggcggcg acatgcgcga caactggcgc
1441 agcgagctgt acaagtacaa ggtggtggag atcaagcccc tgggcatcgc ccccaccaag
1501 gccaagcgcc gcgtggtgca gcgcgagaag cgcgccgtgg gcatcggcgc cgtgttcctg
1561 ggcttcctgg gcgccgcgg cagcaccatg ggcgccgcca gcatcaccct gaccgtgcag
1621 gcccgccagc tgctgagcgg catcgtgcag cagcagagca acctgctgaa ggccatcgag
1681 gcccagcagc acatgctgca gctgaccgtg tgggcatca gcagctgca ggcccgcgtg
1741 ctggccatcg agcgctacct gaaggaccag cagctgctgg gcatctgggg ctgcagcggc
1801 cgcctgatct gcaccaccgc cgtgccctgg aacagcagct ggagcaacaa gagcgagaag
1861 gacatctggg acaacatgac ctggatgcag tgggaccgcg agatcagcaa ctacaccggc
1921 ctgatctaca acctgctgga ggacagccag aaccagcagg agaagaacga agggacctg
1981 ctggagctgg acaagtggaa caacctgtgg aactggttcg acatcagcaa ctggccctgg
2041 tacatcaaga tcttcatcat gatcgtgggc ggcctgatcg gctgcgcat catcttcgcc
2101 gtgctgagca tcgtgaaccg cgtgcgccag gctacagcc cctgagctt ccagaccctg
2161 accccagcc ccgcggcct ggaccgcctg ggcggcatcg aggaggaggg cggcgagcag
2221 gaccgcgacc gcagcatccg cctggtgagc ggcttcctga gctggcctg ggacgacctg
2281 cgcaacctgt gctgttcag ctaccacgc ctgcgcgact tcatcctgat cgccgtgcgc
2341 gccgtggagc tgctgggcca gcagcctg cgcggcctgc agcgcggctg ggagatcctg
2401 aagtacctgg gcagcctggt gcagtactgg ggcctggagc tgaagaagag cgccatcagc
2461 ctgctggaca ccatcgccat caccgtggcc gagggcaccg accgcatcat cgagctggtg
2521 cagcgcatct gccgcgcaat cctgaacatc ccccgccgca tccgccaggg cttcgaggcc
2581 gccctgctgt aa
```

Figure 35A gp160mod.TV1-gagmod.BW965

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg gccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccac caccgagctg cgcgacaaga agcacaagga gtacgccctg
 541 ttctaccgcc tggacatcgt gcccctgaac gagaacagcg acaacttcac ctaccgcctg
 601 atcaactgca acaccagcac catcacccag gcctgcccca aggtgagctt cgaccccatc
 661 cccatccact actgcgcccc cgccggctac gccatcctga gtgcaacaa caagaccttc
 721 aacggcaccg cccctgcta acgtgagc ccgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccagcga cgtgatcggc aacatccgcc aggcccactg caacatcagc
1021 accgaccgct ggaacaagac cctgcagcag gtgatgaaga gctgggcga gcacttcccc
1081 aacaagacca tccagttcaa gcccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagccccat caccctgcag
1261 tgcaagatca agcagatcgt gcgcatgtgg cagggcgtgg gccaggccac ctacgccccc
1321 cccatcgccg gcaacatcac ctgccgcagc aacatcaccg gcatcctgct gacccgcgac
1381 ggcggcttca acaccaccaa caccaccgag accttccgcc ccggcggcgg cgacatgcgc
1441 gacaactggc gcagcgagct gtacaagtac aaggtggtgg agatcaagcc cctgggcatc
1501 gcccccacca aggccaagcg ccgcgtggtg cagcgcgaga gcgcgccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtgggcat caagcagctg
1741 caggcccgcg tgctggccat cgagcgctac ctgaaggacc agcagctgct gggcatctgg
1801 ggctgcagcg gcgcctgat ctgcaccacc gccgtgccct ggaacagcag ctggagcaac
1861 aagagcgaga aggacatctg gacaacatg acctggatgc agtgggaccg cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggccct ggtacatcaa gatcttcatc atgatcgtgg gcggcctgat cggcctgcgc
2101 atcatcttcg ccgtgctgag catcgtgaac cgcgtgcgcc agggctacag ccccctgagc
2161 ttccagaccc tgacccccag ccccgcggc ctggaccgcc tgggcggcat cgaggaggag
2221 ggcggcgagc aggaccgcga ccgcagcatc cgcctggtga gcggcttcct gagcctggcc
2281 tgggacgacc tgcgcaacct gtgcctgttc agctaccacc gcctgcgcga cttcatcctg
2341 atcgccgtgc gcgccgtgga gctgctgggc cacagcagcc tgcgcggcct gcagcgcggc
2401 tgggagatcc tgaagtacct gggcagcctg gtgcagtact ggggcctgga gctgaagaag
2461 agcgccatca gcctgctgga caccatcgcc atcaccgtgg ccgagggcac cgaccgcatc
2521 atcgagctgg tgcagcgcat ctgccgcgcc atcctgaaca ccccccgccg catccgccag
2581 ggcttcgagg ccgccctgct gtaactcgag caagtctaga gggagaccac aacggtttcc
2641 ctctagcggg atcaattccg ccccccccc taacgttact ggccgaagcc gcttggaata
2701 aggccggtgt gcgtttgtct atatgttatt ttccaccata ttgccgtctt ttggcaatgt
2761 gagggcccgg aaacctggcc ctgtcttctt gacgagcatt ctaggggtc tttcccctct
2821 cgccaaagga atgcaaggtc tgttgaatgt cgtgaaggaa gcagttcctc tggaagcttc
2881 ttgaagacaa acaacgtctg tagcgaccct tgcaggcag cggaaccccc cacctggcga
2941 caggtgcctc tgcggccaaa agccacgtgt ataagataca cctgcaaagg cggcacaacc
3001 ccagtgccac gttgtgagtt ggatagttgt ggaaagagtc aaatggctct cctcaagcgt
3061 attcaacaag gggctgaagg atgtgccagaa ggtacccat tgtatgggat ctgatctggg
3121 gcctcggtgc acatgcttta catgtcgttta gtcgaggtta aaaaacgtct aggcccccg
3181 aaccacgggg acgtggtttt cctttgaaaa acacgataat accatgggcg cccgcgccag
3241 catcctgcgc ggcggcaagc tggacgcctg ggagcgcatc gcctgcgcc ccggcggcaa
```

Figure 35B

```
3301 gaagtgctac atgatgaagc acctggtgtg ggccagccgc gagctggaga agttcgccct
3361 gaacccggc ctgctggaga ccagcgaggg ctgcaagcag atcatccgcc agctgcaccc
3421 cgccctgcag accggcagcg aggagctgaa gagcctgttc aacaccgtgg ccaccctgta
3481 ctgcgtgcac gagaagatcg aggtccgcga caccaaggag gccctggaca agatcgagga
3541 ggagcagaac aagtgccagc agaagatcca gcaggccgag gccgccgaca agggcaaggt
3601 gagccagaac taccccatcg tgcagaacct gcagggccag atggtgcacc aggccatcag
3661 cccccgcacc ctgaacgcct gggtgaaggt gatcgaggag aaggccttca gccccgaggt
3721 gatccccatg ttcaccgccc tgagcgaggg cgccacccc caggacctga acacgatgtt
3781 gaacaccgtg ggcggccacc aggccgccat gcagatgctg aaggacacca tcaacgagga
3841 ggccgccgag tgggaccgcg tgcacccgt gcacgccggc cccatcgccc cggccagat
3901 gcgcgagccc cgcggcagcg acatcgccgg caccaccagc accctgcagg agcagatcgc
3961 ctggatgacc agcaaccccc ccatccccgt gggcgacatc tacaagcggt ggatcatcct
4021 gggcctgaac aagatcgtgc ggatgtacag ccccgtgagc atcctggaca tcaagcaggg
4081 ccccaaggag cccttccgcg actacgtgga ccgcttcttc aagaccctgc gcgccgagca
4141 gagcacccag gaggtgaaga actggatgac cgacaccctg ctggtgcaga acgccaaccc
4201 cgactgcaag accatcctgc gcgctctcgg ccccggcgcc agcctggagg agatgatgac
4261 cgcctgccag ggcgtgggcg gcccagcca aaggcccgc gtgctggccg aggcgatgag
4321 ccaggccaac accagcgtga tgatgcagaa gagcaacttc aagggccccc ggcgcatcgt
4381 caagtgcttc aactgcggca aggagggcca catcgcccgc aactgccgcg ccccccgcaa
4441 gaagggctgc tggaagtgcg gcaaggaggg ccaccagatg aaggactgca ccgagcgcca
4501 ggccaacttc ctgggcaaga tctggcccag ccacaagggc cgccccggca acttcctgca
4561 gagccgcccc gagcccaccg ccccccccgc cgagagcttc cgcttcgagg agaccacccc
4621 cggccagaag caggagagca aggaccgcga gaccctgacc agcctgaaga gcctgttcgg
4681 caacgacccc ctgagccaat aa
```

int.opt.mut_C (South Africa TV1)

TTCCTGGACGGCATCGACAAGGCCCAGGAGGAGCACGAGCGCTACCACAGCAACTGGCGCGCCATGGCC
AACGAGTTCAACCTGCCCCCCATCGTGGCCAAGGAGATCGTGGCCAGCGCCGACAAGTGCCAGCTGAAG
GGCGAGGCCATCCACGGCCAGGTGGACTGCAGCCCCGGCATCTGGCAGCTGGCCTGCACCCACCTGGAG
GGCAAGATCATCCTGGTGGCCGTGCACGTGGCCAGCGGCTACATGGAGGCCGAGGTGATCCCCGCCGAG
ACCGGCCAGGAGACCGCCTACTTCATCCTGAAGCTGGCCGGCCGCTGGCCCGTGAAGGTGATCCACACC
GCCAACGGCAGCAACTTCACCAGCACCGCCGTGAAGGCCGCCTGCTGGTGGGCCGGCATCCAGCAGGAG
TTCGGCATCCCCTACAACCCCCAGAGCCAGGGCGTGGTGGCGAGCATGAACAAGGAGCTGAAGAAGATC
ATCGGCCAGGTGCGCGACCAGGCCGAGCACCTGAAGACCGCCGTGCAGATGGCCGTGTTCATCCACAAC
TTCAAGCGCAAGGGCGGCATCGGCGGCTACAGCGCCGGCGAGCGCATCATCGACATCATCGCCACCGAC
ATCCAGACCAAGGAGCTGCAGAAGCAGATCATCCGCATCCAGAACTTCCGCGTGTACTACCGCGACAGC
CGCGACCCCATCAAGGGCCCCGCCGAGCTGCTGTGGAAGGGCGAGGGCGTGGTGGTGATCGAGGACAAG
GGCGACATCAAGGTGGTGCCCCGCCGCAAGGCCAAGATCATCCGCGACTACGGCAAGCAGATGGCCGGC
GCCGACTGCGTGGCCGGCGGCCAGGACGAGGAC

int.opt_C (South Africa TV1)

TTCCTGGACGGCATCGACAAGGCCCAGGAGGAGCACGAGCGCTACCACAGCAACTGGCGCGCCATGGCC
AACGAGTTCAACCTGCCCCCCATCGTGGCCAAGGAGATCGTGGCCAGCTGCGACAAGTGCCAGCTGAAG
GGCGAGGCCATCCACGGCCAGGTGGACTGCAGCCCCGGCATCTGGCAGCTGGACTGCACCCACCTGGAG
GGCAAGATCATCCTGGTGGCCGTGCACGTGGCCAGCGGCTACATGGAGGCCGAGGTGATCCCCGCCGAG
ACCGGCCAGGAGACCGCCTACTTCATCCTGAAGCTGGCCGGCCGCTGGCCCGTGAAGGTGATCCACACC
GACAACGGCAGCAACTTCACCAGCACCGCCGTGAAGGCCGCCTGCTGGTGGGCCGGCATCCAGCAGGAG
TTCGGCATCCCCTACAACCCCAGAGCCAGGGCGTGGTGGAGAGCATGAACAAGGAGCTGAAGAAGATC
ATCGGCCAGGTGCGCGACCAGGCCGAGCACCTGAAGACCGCCGTGCAGATGGCCGTGTTCATCCACAAC
TTCAAGCGCAAGGGCGGCATCGGCGGCTACAGCGCCGGCGAGCGCATCATCGACATCATCGCCACCGAC
ATCCAGACCAAGGAGCTGCAGAAGCAGATCATCCGCATCCAGAACTTCCGCGTGTACTACCGCGACAGC
CGCGACCCCATCTGGAAGGGCCCCGCCGAGCTGCTGTGGAAGGGCGAGGGCGTGGTGGTGATCGAGGAC
AAGGGCGACATCAAGGTGGTGCCCCGCCGCAAGGCCAAGATCATCCGCGACTACGGCAAGCAGATGGCC
GGCGCCGACTGCGTGGCCGGCGGCCAGGACGAGGAC

nef.D106G.-myr19.opt_C (dbl.mutant)

ATGATCCGCCGCACCGAGCCCGCCGCCGAGGGCGTGGGCGCCGCCAGCCAGGACCTGGACAAGCACGGC
GCCCTGACCAGCAGCAACACCGCCGCCAACAACGCCGACTGCGCCTGGCTGGAGGCCCAGGAGGAGGAG
GAGGAGGTGGGCTTCCCCGTGCGCCCCCAGGTGCCCCTGCGCCCCATGACCTACAAGGCCGCCTTCGAC
CTGAGCTTCTTCCTGAAGGAGAAGGGCGGCCTGGAGGGCCTGATCTACAGCAAGAAGCGCCAGGAGATC
CTGGACCTGTGGGTGTACCACACCCAGGGCTTCTTCCCCGGCTGGCAGAACTACACCCCCGGCCCCGGC
GTGCGCTACCCCCTGACCTTCGGCTGGTGCTTCAAGCTGGTGCCCGTGGACCCCCGCGAGGTGGAGGAG
GCCAACAAGGGCGAGAACAACTGCCTGCTGCACCCCATGAGCCAGCACGGCATGGAGGACGAGGACCGC
GAGGTGCTGAAGTGGAAGTTCGACAGCAGCCTGGCCCGCCGCCACATGGCCCGCGAGCTGCACCCCGAG
TACTACAAGGACTGCGCC

p15RnaseH.opt_C

TACGTGGACGGCGCCGCCAACCGCGAGACCAAGATCGGCAAGGCCGGCTACGTGACCGA
CCGGGGCCGGCAGAAGATCGTGAGCCTGACCGAGACCACCAACCAGAAGACCGAGCTGC
AGGCCATCCAGCTGGCCCTGCAGGACAGCGGCAGCGAGGTGAACATCGTGACCGACAGC
CAGTACGCCCTGGGCATCATCCAGGCCCAGCCCGACAAGAGCGAGAGCGAGCTGGTGAA
CCAGATCATCGAGCAGCTGATCAAGAAGGAGAAGGTGTACCTGAGCTGGGTGCCCGCCCA
CAAGGGCATCGGCGGCAACGAGCAGATCGACAAGCTGGTGAGCAAGGGCATCCGCAAGG
TGCTC

p2Pol.opt.YMWM_C

```
GCCACCATGGCCGAGGCCATGAGCCAGGCCACCAGCGCCAACATCCTGATGCAGCGCAGCAACTTCAAG
GGCCCCAAGCGCATCATCAAGTGCTTCAACTGCGGCAAGGAGGGCCACATCGCCCGCAACTGCCGCGCC
CCCCGCAAGAAGGGCTGCTGGAAGTGCGGCAAGGAGGGCCACCAGATGAAGGACTGCACCGAGCGCCAG
GCCAACTTCTTCCGCGAGGACCTGGCCTTCCCCCAGGGCAAGGCCCGCGAGTTCCCCAGCGAGCAGAAC
CGCGCCAACAGCCCCACCAGCCGCGAGCTGCAGGTGCGCGGCGACAACCCCCGCAGCGAGGCCGGCGCC
GAGCGCCAGGGCACCCTGAACTTCCCCCAGATCACCCTGTGGCAGCGCCCCTGGTGAGCATCAAGGTG
GGCGGCCAGATCAAGGAGGCCCTGCTGGCCACCGGCGCCGACGACACCGTGCTGGAGGAGATGAGCCTG
CCCGGCAAGTGGAAGCCCAAGATGATCGGCGGCATCGGCGGCTTCATCAAGGTGCGCCAGTACGACCAG
ATCCTGATCGAGATCTGCGGCAAGAAGGCCATCGGCACCGTGCTGATCGGCCCCACCCCCGTGAACATC
ATCGGCCGCAACATGCTGACCCAGCTGGGCTGCACCCTGAACTTCCCCATCAGCCCCATCGAGACCGTG
CCCGTGAAGCTGAAGCCCGGCATGGACGGCCCCAAGGTGAAGCAGTGGCCCCTGACCGAGGAGAAGATC
AAGGCCCTGACCGCCATCTGCGAGGAGATGGAGAAGGAGGGCAAGATCACCAAGATCGGCCCCGAGAAC
CCCTACAACACCCCCGTGTTCGCCATCAAGAAGAAGGACAGCACCAAGTGGCGCAAGCTGGTGGACTTC
CGCGAGCTGAACAAGCGCACCCAGGACTTCTGGGAGGTGCAGCTGGGCATCCCCCACCCCGCCGGCCTG
AAGAAGAAGAAGAGCGTGACCGTGCTGGACGTGGGCGACGCCTACTTCAGCGTGCCCCTGGACGAGGAC
TTCCGCAAGTACACCGCCTTCACCATCCCCAGCATCAACAACGAGACCCCCGGCATCCGCTACCAGTAC
AACGTGCTGCCCCAGGGCTGGAAGGGCAGCCCCAGCATCTTCCAGAGCAGCATGACCAAGATCCTGGAG
CCCTTCCGCGCCCGCAACCCCGAGATCGTGATCTACCAGGCCCCCCTGTACGTGGGCAGCGACCTGGAG
ATCGGCCAGCACCGCGCCAAGATCGAGGAGCTGCGCAAGCACCTGCTGCGCTGGGGCTTCACCACCCCC
GACAAGAAGCACCAGAAGGAGCCCCCCTTCCTGCCCATCGAGCTGCACCCCGACAAGTGGACCGTGCAG
CCCATCGAGCTGCCCGAGAAGGAGAGCTGGACCGTGAACGACATCCAGAAGCTGGTGGGCAAGCTGAAC
TGGGCCAGCCAGATCTACCCCGGCATCAAGGTGCGCCAGCTGTGCAAGCTGCTGCGCGGCGCCAAGGCC
CTGACCGACATCGTGCCCCTGACCGAGGAGGCCGAGCTGGAGCTGGCCGAGAACCGCGAGATCCTGCGC
GAGCCCGTGCACGGCGTGTACTACGACCCCAGCAAGGACCTGGTGGCCGAGATCCAGAAGCAGGGCCAC
GACCAGTGGACCTACCAGATCTACCAGGAGCCCTTCAAGAACCTGAAGACCGGCAAGTACGCCAAGATG
CGCACCGCCCACACCAACGACGTGAAGCAGCTGACCGAGGCCGTGCAGAAGATCGCCATGGAGAGCATC
GTGATCTGGGGCAAGACCCCCAAGTTCCGCCTGCCCATCCAGAAGGAGACCTGGGAGACCTGGTGGACC
GACTACTGGCAGGCCACCTGGATCCCCGAGTGGGAGTTCGTGAACACCCCCCCCCTGGTGAAGCTGTGG
TACCAGCTGGAGAAGGAGCCCATCATCGGCGCCGAGACCTTCTACGTGGACGGCGCCGCCAACCGCGAG
ACCAAGATCGGCAAGGCCGGCTACGTGACCGACCGGGGCCGGCAGAAGATCGTGAGCCTGACCGAGACC
ACCAACCAGAAGACCGAGCTGCAGGCCATCCAGCTGGCCCTGCAGGACAGCGGCAGCGAGGTGAACATC
GTGACCGACAGCCAGTACGCCCTGGGCATCATCCAGGCCCAGCCCGACAAGAGCGAGAGCGAGCTGGTG
AACCAGATCATCGAGCAGCTGATCAAGAAGGAGAAGGTGTACCTGAGCTGGGTGCCCGCCCACAAGGGC
ATCGGCGGCAACGAGCAGATCGACAAGCTGGTGAGCAAGGGCATCCGCAAGGTGCTGTTCCTGGACGGC
ATCGATGGCGGCATCGTGATCTACCAGTACATGGACGACCTGTACGTGGGCAGCGGCGGCCCTAGGATC
GATTAAAAGCTTCCCGGGGCTAGCACCGGT
```

p2Polopt.YM_C

```
GTCGACGCCACCATGGCCGAGGCCATGAGCCAGGCCACCAGCGCCAACATCCTGATGCAGCGCAGCAAC
TTCAAGGGCCCCAAGCGCATCATCAAGTGCTTCAACTGCGGCAAGGAGGGCCACATCGCCCGCAACTGC
CGCGCCCCCCGCAAGAAGGGCTGCTGGAAGTGCGGCAAGGAGGGCCACCAGATGAAGGACTGCACCGAG
CGCCAGGCCAACTTCTTCCGCGAGGACCTGGCCTTCCCCCAGGGCAAGGCCCGCGAGTTCCCCAGCGAG
CAGAACCGCGCCAACAGCCCCACCAGCCGCGAGCTGCAGGTGCGCGGCGACAACCCCCGCAGCGAGGCC
GGCGCCGAGCGCCAGGGCACCCTGAACTTCCCCCAGATCACCCTGTGGCAGCGCCCCCTGGTGAGCATC
AAGGTGGGCGGCCAGATCAAGGAGGCCCTGCTGGCCACCGGCGCCGACGACACCGTGCTGGAGGAGATG
AGCCTGCCCGGCAAGTGGAAGCCCAAGATGATCGGCGGCATCGGCGGCTTCATCAAGGTGCGCCAGTAC
GACCAGATCCTGATCGAGATCTGCGGCAAGAAGGCCATCGGCACCGTGCTGATCGGCCCCACCCCCGTG
AACATCATCGGCCGCAACATGCTGACCCAGCTGGGCTGCACCCTGAACTTCCCCATCAGCCCCATCGAG
ACCGTGCCCGTGAAGCTGAAGCCCGGCATGGACGGCCCCAAGGTGAAGCAGTGGCCCCTGACCGAGGAG
AAGATCAAGGCCCTGACCGCCATCTGCGAGGAGATGGAGAAGGAGGGCAAGATCACCAAGATCGGCCCC
GAGAACCCCTACAACACCCCCGTGTTCGCCATCAAGAAGAAGGACAGCACCAAGTGGCGCAAGCTGGTG
GACTTCCGCGAGCTGAACAAGCGCACCCAGGACTTCTGGGAGGTGCAGCTGGGCATCCCCCACCCCGCC
GGCCTGAAGAAGAAGAAGAGCGTGACCGTGCTGGACGTGGGCGACGCCTACTTCAGCGTGCCCCTGGAC
GAGGACTTCCGCAAGTACACCGCCTTCACCATCCCCAGCATCAACAACGAGACCCCCGGCATCCGCTAC
CAGTACAACGTGCTGCCCCAGGGCTGGAAGGGCAGCCCCAGCATCTTCCAGAGCAGCATGACCAAGATC
CTGGAGCCCTTCCGCGCCCGCAACCCCGAGATCGTGATCTACCAGGCCCCCCTGTACGTGGGCAGCGAC
CTGGAGATCGGCCAGCACCGCGCCAAGATCGAGGAGCTGCGCAAGCACCTGCTGCGCTGGGGCTTCACC
ACCCCCGACAAGAAGCACCAGAAGGAGCCCCCCTTCCTGTGGATGGGCTACGAGCTGCACCCCGACAAG
TGGACCGTGCAGCCCATCGAGCTGCCCGAGAAGGAGAGCTGGACCGTGAACGACATCCAGAAGCTGGTG
GGCAAGCTGAACTGGGCCAGCCAGATCTACCCCGGCATCAAGGTGCGCCAGCTGTGCAAGCTGCTGCGC
GGCGCCAAGGCCCTGACCGACATCGTGCCCCTGACCGAGGAGGCCGAGCTGGAGCTGGCCGAGAACCGC
GAGATCCTGCGCGAGCCCGTGCACGGCGTGTACTACGACCCCAGCAAGGACCTGGTGGCCGAGATCCAG
AAGCAGGGCCACGACCAGTGGACCTACCAGATCTACCAGGAGCCCTTCAAGAACCTGAAGACCGGCAAG
TACGCCAAGATGCGCACCGCCCACACCAACGACGTGAAGCAGCTGACCGAGGCCGTGCAGAAGATCGCC
ATGGAGAGCATCGTGATCTGGGGCAAGACCCCCAAGTTCCGCCTGCCCATCCAGAAGGAGACCTGGGAG
ACCTGGTGGACCGACTACTGGCAGGCCACCTGGATCCCCGAGTGGGAGTTCGTGAACACCCCCCCCCTG
GTGAAGCTGTGGTACCAGCTGGAGAAGGAGCCCATCATCGGCGCCGAGACCTTCTACGTGGACGGCGCC
GCCAACCGCGAGACCAAGATCGGCAAGGCCGGCTACGTGACCGACCGGGGCCGGCAGAAGATCGTGAGC
CTGACCGAGACCACCAACCAGAAGACCGAGCTGCAGGCCATCCAGCTGGCCCTGCAGGACAGCGGCAGC
GAGGTGAACATCGTGACCGACAGCCAGTACGCCCTGGGCATCATCCAGGCCCAGCCCGACAAGAGCGAG
AGCGAGCTGGTGAACCAGATCATCGAGCAGCTGATCAAGAAGGAGAAGGTGTACCTGAGCTGGGTGCCC
GCCCACAAGGGCATCGGCGGCAACGAGCAGATCGACAAGCTGGTGAGCAAGGGCATCCGCAAGGTGCTG
TTCCTGGACGGCATCGATGGCGGCATCGTGATCTACCAGTACATGGACGACCTGTACGTGGGCAGCGGC
GGCCCTAGGATCGATTAAAAGCTTCCCGGGGCTAGCACCGGT
```

p2Polopt_C

```
GCCACCATGGCCGAGGCCATGAGCCAGGCCACCAGCGCCAACATCCTGATGCAGCGCAGCAACTTCAAG
GGCCCCAAGCGCATCATCAAGTGCTTCAACTGCGGCAAGGAGGGCCACATCGCCCGCAACTGCCGCGCC
CCCCGCAAGAAGGGCTGCTGGAAGTGCGGCAAGGAGGGCCACCAGATGAAGGACTGCACCGAGCGCCAG
GCCAACTTCTTCCGCGAGGACCTGGCCTTCCCCCAGGGCAAGGCCCGCGAGTTCCCCAGCGAGCAGAAC
CGCGCCAACAGCCCCACCAGCCGCGAGCTGCAGGTGCGCGGCGACAACCCCGCAGCGAGGCCGGCGCC
GAGCGCCAGGGCACCCTGAACTTCCCCCAGATCACCCTGTGGCAGCGCCCCCTGGTGAGCATCAAGGTG
GGCGGCCAGATCAAGGAGGCCCTGCTGGACACCGGCGCCGACGACACCGTGCTGGAGGAGATGAGCCTG
CCCGGCAAGTGGAAGCCCAAGATGATCGGCGGCATCGGCGGCTTCATCAAGGTGCGCCAGTACGACCAG
ATCCTGATCGAGATCTGCGGCAAGAAGGCCATCGGCACCGTGCTGATCGGCCCCACCCCCGTGAACATC
ATCGGCCGCAACATGCTGACCCAGCTGGGCTGCACCCTGAACTTCCCCATCAGCCCCATCGAGACCGTG
CCCGTGAAGCTGAAGCCCGGCATGGACGGCCCCAAGGTGAAGCAGTGGCCCCTGACCGAGGAGAAGATC
AAGGCCCTGACCGCCATCTGCGAGGAGATGGAGAAGGAGGGCAAGATCACCAAGATCGGCCCCGAGAAC
CCCTACAACACCCCCGTGTTCGCCATCAAGAAGAAGGACAGCACCAAGTGGCGCAAGCTGGTGGACTTC
CGCGAGCTGAACAAGCGCACCCAGGACTTCTGGGAGGTGCAGCTGGGCATCCCCCACCCCGCCGGCCTG
AAGAAGAAGAAGAGCGTGACCGTGCTGGACGTGGGCGACGCCTACTTCAGCGTGCCCCTGGACGAGGAC
TTCCGCAAGTACACCGCCTTCACCATCCCCAGCATCAACAACGAGACCCCCGGCATCCGCTACCAGTAC
AACGTGCTGCCCCAGGGCTGGAAGGGCAGCCCCAGCATCTTCCAGAGCAGCATGACCAAGATCCTGGAG
CCCTTCCGCGCCCGCAACCCCGAGATCGTGATCTACCAGTACATGGACGACCTGTACGTGGGCAGCGAC
CTGGAGATCGGCCAGCACCGCGCCAAGATCGAGGAGCTGCGCAAGCACCTGCTGCGCTGGGGCTTCACC
ACCCCCGACAAGAAGCACCAGAAGGAGCCCCCCTTCCTGTGGATGGGCTACGAGCTGCACCCCGACAAG
TGGACCGTGCAGCCCATCGAGCTGCCCGAGAAGGAGAGCTGGACCGTGAACGACATCCAGAAGCTGGTG
GGCAAGCTGAACTGGGCCAGCCAGATCTACCCCGGCATCAAGGTGCGCCAGCTGTGCAAGCTGCTGCGC
GGCGCCAAGGCCCTGACCGACATCGTGCCCCTGACCGAGGAGGCCGAGCTGGAGCTGGCCGAGAACCGC
GAGATCCTGCGCGAGCCCGTGCACGGCGTGTACTACGACCCCAGCAAGGACCTGGTGGCCGAGATCCAG
AAGCAGGGCCACGACCAGTGGACCTACCAGATCTACCAGGAGCCCTTCAAGAACCTGAAGACCGGCAAG
TACGCCAAGATGCGCACCGCCCACACCAACGACGTGAAGCAGCTGACCGAGGCCGTGCAGAAGATCGCC
ATGGAGAGCATCGTGATCTGGGGCAAGACCCCCAAGTTCCGCCTGCCCATCCAGAAGGAGACCTGGGAG
ACCTGGTGGACCGACTACTGGCAGGCCACCTGGATCCCCGAGTGGGAGTTCGTGAACACCCCCCCCCTG
GTGAAGCTGTGGTACCAGCTGGAGAAGGAGCCCATCATCGGCGCCGAGACCTTCTACGTGGACGGCGCC
GCCAACCGCGAGACCAAGATCGGCAAGGCCGGCTACGTGACCGACCGGGGCCGGCAGAAGATCGTGAGC
CTGACCGAGACCACCAACCAGAAGACCGAGCTGCAGGCCATCCAGCTGGCCCTGCAGGACAGCGGCAGC
GAGGTGAACATCGTGACCGACAGCCAGTACGCCCTGGGCATCATCCAGGCCCAGCCCGACAAGAGCGAG
AGCGAGCTGGTGAACCAGATCATCGAGCAGCTGATCAAGAAGGAGAAGGTGTACCTGAGCTGGGTGCCC
GCCCACAAGGGCATCGGCGGCAACGAGCAGATCGACAAGCTGGTGAGCAAGGGCATCCGCAAGGTGCTG
TTCCTGGACGGCATCGATGGCGGCATCGTGATCTACCAGTACATGGACGACCTGTACGTGGGCAGCGGC
GGCCCTAGGATCGATTAAAAGCTTCCCGGGGCTAGCACCGGT
```

p2PolTatRevNef.opt_C

```
GTCGACGCCACCATGGAGCCCGTGGACCCCAACCTGGAGCCCTGGAACCACCCCGGCAGCCAGCCCAAG
ACCGCCGGCAACAAGTGCTACTGCAAGCACTGCAGCTACCACTGCCTGGTGAGCTTCCAGACCAAGGGC
CTGGGCATCAGCTACGGCCGCAAGAAGCGCCGCCAGCGCCGCAGCGCCCCCCCCAGCAGCGAGGACCAC
CAGAACCCCATCAGCAAGCAGCCCCTGCCCCAGACCCGCGGCGACCCCACCGGCAGCGAGGAGAGCAAG
AAGAAGGTGGAGAGCAAGACCGAGACCGACCCCTTCGACCCCGGGGCCGGCCGCAGCGGCGACAGCGAC
GAGGCCCTGCTGCAGGCCGTGCGCATCATCAAGATCCTGTACCAGAGCAACCCCTACCCCAAGCCCGAG
GGCACCCGCCAGGCCGACCTGAACCGCCGCCGCCGCTGGCGCGCCCGCCAGCGCCAGATCCACAGCATC
AGCGAGCGCATCCTGAGCACCTGCCTGGGCCGCCCCGCCGAGCCCGTGCCCTTCCAGCTGCCCCCCGAC
CTGCGCCTGCACATCGACTGCAGCGAGAGCAGCGGCACCAGCGGCACCCAGCAGAGCCAGGGCACCACC
GAGGGCGTGGGCAGCCCCCTCGAGGCCGGCAAGTGGAGCAAGAGCAGCATCGTGGGCTGGCCCGCCGTG
CGCGAGCGCATCCGCCGCACCGAGCCCGCCGCCGAGGGCGTGGGCGCCGCCAGCCAGGACCTGGACAAG
CACGGCGCCCTGACCAGCAGCAACACCGCCGCCAACAACGCCGACTGCGCCTGGCTGGAGGCCCAGGAG
GAGGAGGAGGAGGTGGGCTTCCCCGTGCGCCCCCAGGTGCCCCTGCGCCCCCATGACCTACAAGGCCGCC
TTCGACCTGAGCTTCTTCCTGAAGGAGAAGGGCGGCCTGGAGGGCCTGATCTACAGCAAGAAGCGCCAG
GAGATCCTGGACCTGTGGGTGTACCACACCCAGGGCTTCTTCCCCGGCTGGCAGAACTACACCCCCGGC
CCCGGCGTGCGCTACCCCCTGACCTTCGGCTGGTGCTTCAAGCTGGTGCCCGTGGACCCCGCGAGGTG
GAGGAGGCCAACAAGGGCGAGAACAACTGCCTGCTGCACCCCATGAGCCAGCACGGCATGGAGGACGAG
GACCGCGAGGTGCTGAAGTGGAAGTTCGACAGCAGCCTGGCCCGCCGCCACATGGCCCGCGAGCTGCAC
CCCGAGTACTACAAGGACTGCGAATTCGCCGAGGCCATGAGCCAGGCCACCAGCGCCAACATCCTGATG
CAGCGCAGCAACTTCAAGGGCCCCAAGCGCATCATCAAGTGCTTCAACTGCGGCAAGGAGGGCCACATC
GCCCGCAACTGCCGCGCCCCCCGCAAGAAGGGCTGCTGGAAGTGCGGCAAGGAGGGCCACCAGATGAAG
GACTGCACCGAGCGCCAGGCCAACTTCTTCCGCGAGGACCTGGCCTTCCCCAGGGCAAGGCCCGCGAG
TTCCCCAGCGAGCAGAACCGCGCCAACAGCCCCACCAGCCGCGAGCTGCAGGTGCGCGGCGACAACCCC
CGCAGCGAGGCCGGCGCCGAGCGCCAGGGCACCCTGAACTTCCCCCAGATCACCCTGTGGCAGCGCCCC
CTGGTGAGCATCAAGGTGGGCGGCCAGATCAAGGAGGCCCTGCTGGCCACCGGCGCCGACGACACCGTG
CTGGAGGAGATGAGCCTGCCCGGCAAGTGGAAGCCCAAGATGATCGGCGGCATCGGCGGCTTCATCAAG
GTGCGCCAGTACGACCAGATCCTGATCGAGATCTGCGGCAAGAAGGCCATCGGCACCGTGCTGATCGGC
CCCACCCCCGTGAACATCATCGGCCGCAACATGCTGACCCAGCTGGGCTGCACCCTGAACTTCCCCATC
AGCCCCATCGAGACCGTGCCCGTGAAGCTGAAGCCCGGCATGGACGGCCCCAAGGTGAAGCAGTGGCCC
CTGACCGAGGAGAAGATCAAGGCCCTGACCGCCATCTGCGAGGAGATGGAGAAGGAGGGCAAGATCACC
AAGATCGGCCCCGAGAACCCCTACAACACCCCCGTGTTCGCCATCAAGAAGAAGGACAGCACCAAGTGG
CGCAAGCTGGTGGACTTCCGCGAGCTGAACAAGCGCACCCAGGACTTCTGGGAGGTGCAGCTGGGCATC
CCCCACCCCGCCGGCCTGAAGAAGAAGAAGAGCGTGACCGTGCTGGACGTGGGCGACGCCTACTTCAGC
GTGCCCCTGGACGAGGACTTCCGCAAGTACACCGCCTTCACCATCCCCAGCATCAACAACGAGACCCCC
GGCATCCGCTACCAGTACAACGTGCTGCCCCAGGGCTGGAAGGGCAGCCCCAGCATCTTCCAGAGCAGC
ATGACCAAGATCCTGGAGCCCTTCCGCGCCCGCAACCCCGAGATCGTGATCTACCAGGCCCCCCTGTAC
GTGGGCAGCGACCTGGAGATCGGCCAGCACCGCCAAGATCGAGGAGCTGCGCAAGCACCTGCTGCGC
TGGGGCTTCACCACCCCCGACAAGAAGCACCAGAAGGAGCCCCCCTTCCTGCCCATCGAGCTGCACCCC
GACAAGTGGACCGTGCAGCCCATCGAGCTGCCCGAGAAGGAGAGCTGGACCGTGAACGACATCCAGAAG
CTGGTGGGCAAGCTGAACTGGGCCAGCCAGATCTACCCCGGCATCAAGGTGCGCCAGCTGTGCAAGCTG
CTGCGCGGCGCCAAGGCCCTGACCGACATCGTGCCCCTGACCGAGGAGGCCGAGCTGGAGCTGGCCGAG
AACCGCGAGATCCTGCGCGAGCCCGTGCACGGCGTGTACTACGACCCCAGCAAGGACCTGGTGGCCGAG
ATCCAGAAGCAGGGCCACGACCAGTGGACCTACCAGATCTACCAGGAGCCCTTCAAGAACCTGAAGACC
GGCAAGTACGCCAAGATGCGCACCGCCCACACCAACGACGTGAAGCAGCTGACCGAGGCCGTGCAGAAG
ATCGCCATGGAGAGCATCGTGATCTGGGGCAAGACCCCCAAGTTCCGCCTGCCCATCCAGAAGGAGACC
TGGGAGACCTGGTGGACCGACTACTGGCAGGCCACCTGGATCCCCGAGTGGGAGTTCGTGAACACCCCC
CCCCTGGTGAAGCTGTGGTACCAGCTGGAGAAGGAGCCCATCATCGGCGCCGAGACCTTCTACGTGGAC
GGCGCCGCCAACCGCGAGACCAAGATCGGCAAGGCCGGCTACGTGACCGACCGGGCCGGCAGAAGATC
GTGAGCCTGACCGAGACCACCAACCAGAAGACCGAGCTGCAGGCCATCCAGCTGGCCCTGCAGGACAGC
GGCAGCGAGGTGAACATCGTGACCGACAGCCAGTACGCCCTGGGCATCATCCAGGCCCAGCCCGACAAG
AGCGAGAGCGAGCTGGTGAACCAGATCATCGAGCAGCTGATCAAGAAGGAGAAGGTGTACCTGAGCTGG
GTGCCCGCCCACAAGGGCATCGGCGGCAACGAGCAGATCGACAAGCTGGTGAGCAAGGGCATCCGCAAG
GTGCTGTAA
```

p2PolTatRevNef.opt.native_C

```
GCCACCATGGCCGAGGCCATGAGCCAGGCCACCAGCGCCAACATCCTGATGCAGCGCAGCAACTTCAAG
GGCCCCAAGCGCATCATCAAGTGCTTCAACTGCGGCAAGGAGGGCCACATCGCCCGCAACTGCCGCGCC
CCCCGCAAGAAGGGCTGCTGGAAGTGCGGCAAGGAGGGCCACCAGATGAAGGACTGCACCGAGCGCCAG
GCCAACTTCTTCCGCGAGGACCTGGCCTTCCCCCAGGGCAAGGCCCGCGAGTTCCCCAGCGAGCAGAAC
CGCGCCAACAGCCCCACCAGCCGCGAGCTGCAGGTGCGCGGCGACAACCCCCGCAGCGAGGCCGGCGCC
GAGCGCCAGGGCACCCTGAACTTCCCCCAGATCACCCTGTGGCAGCGCCCCCTGGTGAGCATCAAGGTG
GGCGGCCAGATCAAGGAGGCCCTGCTGGACACCGGCGCCGACGACACCGTGCTGGAGGAGATGAGCCTG
CCCGGCAAGTGGAAGCCCAAGATGATCGGCGGCATCGGCGGCTTCATCAAGGTGCGCCAGTACGACCAG
ATCCTGATCGAGATCTGCGGCAAGAAGGCCATCGGCACCGTGCTGATCGGCCCCACCCCCGTGAACATC
ATCGGCCGCAACATGCTGACCCAGCTGGGCTGCACCCTGAACTTCCCCATCAGCCCCATCGAGACCGTG
CCCGTGAAGCTGAAGCCCGGCATGGACGGCCCCAAGGTGAAGCAGTGGCCCCTGACCGAGGAGAAGATC
AAGGCCCTGACCGCCATCTGCGAGGAGATGGAGAAGGAGGGCAAGATCACCAAGATCGGCCCCGAGAAC
CCCTACAACACCCCCGTGTTCGCCATCAAGAAGAAGGACAGCACCAAGTGGCGCAAGCTGGTGGACTTC
CGCGAGCTGAACAAGCGCACCCAGGACTTCTGGGAGGTGCAGCTGGGCATCCCCCACCCCGCCGGCCTG
AAGAAGAAGAAGAGCGTGACCGTGCTGGACGTGGGCGACGCCCTACTTCAGCGTGCCCCTGGACGAGGAC
TTCCGCAAGTACACCGCCTTCACCATCCCCAGCATCAACAACGAGACCCCCGGCATCCGCTACCAGTAC
AACGTGCTGCCCCAGGGCTGGAAGGGCAGCCCCAGCATCTTCCAGAGCAGCATGACCAAGATCCTGGAG
CCCTTCCGCGCCCGCAACCCCGAGATCGTGATCTACCAGTACATGGACGACCTGTACGTGGGCAGCGAC
CTGGAGATCGGCCAGCACCGCGCCAAGATCGAGGAGCTGCGCAAGCACCTGCTGCGCTGGGGCTTCACC
ACCCCCGACAAGAAGCACCAGAAGGAGCCCCCCTTCCTGTGGATGGGCTACGAGCTGCACCCCGACAAG
TGGACCGTGCAGCCCATCGAGCTGCCCGAGAAGGAGAGCTGGACCGTGAACGACATCCAGAAGCTGGTG
GGCAAGCTGAACTGGGCCAGCCAGATCTACCCCGGCATCAAGGTGCGCCAGCTGTGCAAGCTGCTGCGC
GGCGCCAAGGCCCTGACCGACATCGTGCCCCTGACCGAGGAGGCCGAGCTGGAGCTGGCCGAGAACCGC
GAGATCCTGCGCGAGCCCGTGCACGGCGTGTACTACGACCCCAGCAAGGACCTGGTGGCCGAGATCCAG
AAGCAGGGCCACGACCAGTGGACCTACCAGATCTACCAGGAGCCCTTCAAGAACCTGAAGACCGGCAAG
TACGCCAAGATGCGCACCGCCCACACCAACGACGTGAAGCAGCTGACCGAGGCCGTGCAGAAGATCGCC
ATGGAGAGCATCGTGATCTGGGGCAAGACCCCCAAGTTCCGCCTGCCCATCCAGAAGGAGACCTGGGAG
ACCTGGTGGACCGACTACTGGCAGGCCACCTGGATCCCCGAGTGGGAGTTCGTGAACACCCCCCCCCTG
GTGAAGCTGTGGTACCAGCTGGAGAAGGAGCCCATCATCGGCGCCGAGACCTTCTACGTGGACGGCGCC
GCCAACCGCGAGACCAAGATCGGCAAGGCCGGCTACGTGACCGACCGGGGCCGGCAGAAGATCGTGAGC
CTGACCGAGACCACCAACCAGAAGACCGAGCTGCAGGCCATCCAGCTGGCCCTGCAGGACAGCGGCAGC
GAGGTGAACATCGTGACCGACAGCCAGTACGCCCTGGGCATCATCCAGGCCCAGCCCGACAAGAGCGAG
AGCGAGCTGGTGAACCAGATCATCGAGCAGCTGATCAAGAAGGAGAAGGTGTACCTGAGCTGGGTGCCC
GCCCACAAGGGCATCGGCGGCAACGAGCAGATCGACAAGCTGGTGAGCAAGGGCATCCGCAAGGTGCTG
GAATTCGAGCCCGTGGACCCCAACCTGGAGCCCTGGAACCACCCCGGCAGCCAGCCCAAGACCGCCTGC
AACAAGTGCTACTGCAAGCACTGCAGCTACCACTGCCTGGTGTGCTTCCAGACCAAGGGCCTGGGCATC
AGCTACGGCCGCAAGAAGCGCCGCCAGCGCCGCAGCGCCCCCCCCAGCAGCGAGGACCACCAGAACCCC
ATCAGCAAGCAGCCCCTGCCCCAGACCCGCGGCGACCCCACCGGCAGCGAGGAGAGCAAGAAGAAGGTG
GAGAGCAAGACCGAGACCGACCCCTTCGACCCCGGGGCCGGCCGCAGCGGCGACAGCGACGAGGCCCTG
CTGCAGGCCGTGCGCATCATCAAGATCCTGTACCAGAGCAACCCCTACCCCAAGCCCGAGGGCACCCGC
CAGGCCCGCAAGAACCGCCGCCGCCGCTGGCGCGCCCGCCAGCGCCAGATCCACAGCATCAGCGAGCGC
ATCCTGAGCACCCTGCCTGGGCCGCCCCGCCGAGCCCGTGCCCTTCCAGCTGCCCCCCATCGAGCGCCTG
CACATCGACTGCAGCGAGAGCAGCGGCACCAGCGGCACCCAGCAGAGCCAGGGCACCACCGAGGGCGTG
GGCAGCCCCTCGAGGGCGGCAAGTGGAGCAAGAGCAGCATCGTGGGCTGGCCCGCCGTGCGCGAGCGC
ATCCGCCGCACCGAGCCCGCCCGCGAGGGCGCCGCCGAGGGCGCCGCCGAGGGCGTGGGCGCCGCCAGC
CAGGACCTGGACAAGCACGGCGCCCTGACCAGCAGCAACACCGCCGCCAACAACGCCGACTGCGCCTGG
CTGGAGGCCCAGGAGGAGGAGGAGGAGGTGGGCTTCCCCGTGCGCCCCCAGGTGCCCCTGCGCCCCATG
ACCTACAAGGCCGCCTTCGACCTGAGCTTCTTCCTGAAGGAGAAGGGCGGCCTGGAGGGCCTGATCTAC
AGCAAGAAGCGCCAGGAGATCCTGGACCTGTGGGTGTACCACACCCAGGGCTTCTTCCCCGACTGGCAG
AACTACACCCCCGGCCCCGGCGTGCGCTACCCCCTGACCTTCGGCTGGTGCTTCAAGCTGGTGCCCGTG
GACCCCCGCGAGGTGGAGGAGGCCAACAAGGGCGAGAACAACTGCCTGCTGCACCCCATGAGCCAGCAC
GGCATGGAGGACGAGGACCGCGAGGTGCTGAAGTGGAAGTTCGACAGCAGCCTGGCCCGCCGCCACATG
GCCCGCGAGCTGCACCCCGAGTACTACAAGGACTGC
```

p2PolTatRevNef.opt_C

```
GTCGACGCCACCATGGCCGAGGCCATGAGCCAGGCCACCAGCGCCAACATCCTGATGC.ICGCAGCAAC
TTCAAGGGCCCCAAGCGCATCATCAAGTGCTTCAACTGCGGCAAGGAGGGCCACATCGCCCGCAACTGC
CGCGCCCCCCGCAAGAAGGGCTGCTGGAAGTGCGGCAAGGAGGGCCACCAGATGAAGGACTGCACCGAG
CGCCAGGCCAACTTCTTCCGCGAGGACCTGGCCTTCCCCCAGGGCAAGGCCCGCGAGTTCCCCAGCGAG
CAGAACCGCGCCAACAGCCCCACCAGCCGCGAGCTGCAGGTGCGCGGCGACAACCCCCGCAGCGAGGCC
GGCGCCGAGCGCCAGGGCACCCTGAACTTCCCCCAGATCACCCTGTGGCAGCGCCCCTGGTGAGCATC
AAGGTGGGCGGCCAGATCAAGGAGGCCCTGCTGGCCACCGGCGCCGACGACACCGTGCTGGAGGAGATG
AGCCTGCCCGGCAAGTGGAAGCCCAAGATGATCGGCGGCATCGGCGGCTTCATCAAGGTGCGCCAGTAC
GACCAGATCCTGATCGAGATCTGCGGCAAGAAGGCCATCGGCACCGTGCTGATCGGCCCCACCCCCGTG
AACATCATCGGCCGCAACATGCTGACCCAGCTGGGCTGCACCCTGAACTTCCCCATCAGCCCCATCGAG
ACCGTGCCCGTGAAGCTGAAGCCCGGCATGGACGGCCCCAAGGTGAAGCAGTGGCCCCTGACCGAGGAG
AAGATCAAGGCCCTGACCGCCATCTGCGAGGAGATGGAGAAGGAGGGCAAGATCACCAAGATCGGCCCC
GAGAACCCCTACAACACCCCCGTGTTCGCCATCAAGAAGAAGGACAGCACCAAGTGGCGCAAGCTGGTG
GACTTCCGCGAGCTGAACAAGCGCACCCAGGACTTCTGGGAGGTGCAGCTGGGCATCCCCCACCCCGCC
GGCCTGAAGAAGAAGAAGAGCGTGACCGTGCTGGACGTGGGCGACGCCTACTTCAGCGTGCCCCTGGAC
GAGGACTTCCGCAAGTACACCGCCTTCACCATCCCCAGCATCAACAACGAGACCCCCGGCATCCGCTAC
CAGTACAACGTGCTGCCCCAGGGCTGGAAGGGCAGCCCCAGCATCTTCCAGAGCAGCATGACCAAGATC
CTGGAGCCCTTCCGCGCCCGCAACCCCGAGATCGTGATCTACCAGGCCCCCCTGTACGTGGGCAGCGAC
CTGGAGATCGGCCAGCACCGCGCCAAGATCGAGGAGCTGCGCAAGCACCTGCTGCGCTGGGGCTTCACC
ACCCCCGACAAGAAGCACCAGAAGGAGCCCCCCTTCCTGCCCATCGAGCTGCACCCCGACAAGTGGACC
GTGCAGCCCATCGAGCTGCCCGAGAAGGAGAGCTGGACCGTGAACGACATCCAGAAGCTGGTGGGCAAG
CTGAACTGGGCCAGCCAGATCTACCCCGGCATCAAGGTGCGCCAGCTGTGCAAGCTGCTGCGCGGCGCC
AAGGCCCTGACCGACATCGTGCCCCTGACCGAGGAGGCCGAGCTGGAGCTGGCCGAGAACCGCGAGATC
CTGCGCGAGCCCGTGCACGGCGTGTACTACGACCCCAGCAAGGACCTGGTGGCCGAGATCCAGAAGCAG
GGCCACGACCAGTGGACCTACCAGATCTACCAGGAGCCCTTCAAGAACCTGAAGACCGGCAAGTACGCC
AAGATGCGCACCGCCCACACCAACGACGTGAAGCAGCTGACCGAGGCCGTGCAGAAGATCGCCATGGAG
AGCATCGTGATCTGGGGCAAGACCCCCAAGTTCCGCCTGCCCATCCAGAAGGAGACCTGGGAGACCTGG
TGGACCGACTACTGGCAGGCCACCTGGATCCCCGAGTGGGAGTTCGTGAACACCCCCCCCCTGGTGAAG
CTGTGGTACCAGCTGGAGAAGGAGCCCATCATCGGCGCCGAGACCTTCTACGTGGACGGCGCCGCCAAC
CGCGAGACCAAGATCGGCAAGGCCGGCTACGTGACCGACCGGGGCCGGCAGAAGATCGTGAGCCTGACC
GAGACCACCAACCAGAAGACCGAGCTGCAGGCCATCCAGCTGGCCCTGCAGGACAGCGGCAGCGAGGTG
AACATCGTGACCGACAGCCAGTACGCCCTGGGCATCATCCAGGCCCAGCCCGACAAGAGCGAGAGCGAG
CTGGTGAACCAGATCATCGAGCAGCTGATCAAGAAGGAGAAGGTGTACCTGAGCTGGGTGCCCGCCCAC
AAGGGCATCGGCGGCAACGAGCAGATCGACAAGCTGGTGAGCAAGGGCATCCGCAAGGTGCTGGAATTC
GAGCCCGTGGACCCCAACCTGGAGCCCTGGAACCACCCCGGCAGCCAGCCCAAGACCGCCGGCAACAAG
TGCTACTGCAAGCACTGCAGCTACCACTGCCTGGTGAGCTTCAGACCAAGGGCCTGGGCATCAGCTAC
GGCCGCAAGAAGCGCCGCCAGCGCCGCAGCGCCCCCCCCAGCAGCGAGGACCACCAGAACCCCATCAGC
AAGCAGCCCCTGCCCCAGACCCGCGGCGACCCCACCGGCAGCGAGGAGAGCAAGAAGAAGGTGGAGAGC
AAGACCGAGACCGACCCCTTCGACCCCGGGGCCGGCCGCAGCGGCGACAGCGACGAGGCCCTGCTGCAG
GCCGTGCGCATCATCAAGATCCTGTACCAGAGCAACCCCTACCCCAAGCCCGAGGGCACCCGCCAGGCC
GACCTGAACCGCCGCCGCCGCTGGCGCGCCCGCCAGCGCCAGATCCACAGCATCAGCGAGCGCATCCTG
AGCACCTGCCTGGGCCGCCCCGCCGAGCCCGTGCCCTTCCAGCTGCCCCCCGACCTGCCCTGCACATC
GACTGCAGCGAGAGCAGCGGCACCAGCGGCACCCAGCAGAGCCAGGGCACCACCGAGGGCGTGGGCAGC
CCCCTCGAGGCCGGCCAAGTGGAGCAAGAGCAGCATCGTGGGCTGGCCCGCCGTGCGCGAGCGCATCCGC
CGCACCGAGCCCGCCGCCGAGGGCGTGGGCGCCGCCAGCCAGGACCTGGACAAGCACGGCGCCCTGACC
AGCAGCAACACCGCCGCCAACAACGCCGACTGCGCCTGGCTGGAGGCCCAGGAGGAGGAGGAGGAGGTG
GGCTTCCCCGTGCGCCCCCAGGTGCCCCTGCGCCCCATGACCTACAAGGCCGCCTTCGACCTGAGCTTC
TTCCTGAAGGAGAAGGGCGGCCTGGAGGGCCTGATCTACAGCAAGAAGCGCCAGGAGATCCTGGACCTG
TGGGTGTACCACACCCAGGGCTTCTTCCCCGGCTGGCAGAACTACACCCCCGGCCCCGGCGTGCGCTAC
CCCCTGACCTTCGGCTGGTGCTTCAAGCTGGTGCCCGTGGACCCCCGCGAGGTGGAGGAGGCCAACAAG
GGCGAGAACAACTGCCTGCTGCACCCCATGAGCCAGCACGGCATGGAGGACGAGGACCGCGAGGTGCTG
AAGTGGAAGTTCGACAGCAGCCTGGCCCGCCGCCACATGGCCCGCGAGCTGCACCCCGAGTACTACAAG
GACTGCGCCTAAATCTAGA
```

protInaRT.YM.opt_C

```
CCCCAGATCACCCTGTGGCAGCGCCCCCTGGTGAGCATCAAGGTGGGCGGCCAGATCAAGGAGGCCCTG
CTGGCCACCGGCGCCGACGACACCGTGCTGGAGGAGATGAGCCTGCCCGGCAAGTGGAAGCCCAAGATG
ATCGGCGGCATCGGCGGCTTCATCAAGGTGCGCCAGTACGACCAGATCCTGATCGAGATCTGCGGCAAG
AAGGCCATCGGCACCGTGCTGATCGGCCCCACCCCCGTGAACATCATCGGCCGCAACATGCTGACCCAG
CTGGGCTGCACCCTGAACTTCCCCATCAGCCCCATCGAGACCGTGCCCGTGAAGCTGAAGCCCGGCATG
GACGGCCCCAAGGTGAAGCAGTGGCCCCTGACCGAGGAGAAGATCAAGGCCCTGACCGCCATCTGCGAG
GAGATGGAGAAGGAGGGCAAGATCACCAAGATCGGCCCCGAGAACCCCTACAACACCCCCGTGTTCGCC
ATCAAGAAGAAGGACAGCACCAAGTGGCGCAAGCTGGTGGACTTCCGCGAGCTGAACAAGCGCACCCAG
GACTTCTGGGAGGTGCAGCTGGGCATCCCCCACCCCGCCGGCCTGAAGAAGAAGAAGAGCGTGACCGTG
CTGGACGTGGGCGACGCCTACTTCAGCGTGCCCCTGGACGAGGACTTCCGCAAGTACACCGCCTTCACC
ATCCCCAGCATCAACAACGAGACCCCCGGCATCCGCTACCAGTACAACGTGCTGCCCCAGGGCTGGAAG
GGCAGCCCCAGCATCTTCCAGAGCAGCATGACCAAGATCCTGGAGCCCTTCCGCGCCCGCAACCCCGAG
ATCGTGATCTACCAGGCCCCCCTGTACGTGGGCAGCGACCTGGAGATCGGCCAGCACCGCGCCAAGATC
GAGGAGCTGCGCAAGCACCTGCTGCGCTGGGCTTCACCACCCCCGACAAGAAGCACCAGAAGGAGCCC
CCCTTCCTGTGGATGGGCTACGAGCTGCACCCCGACAAGTGGACCGTGCAGCCCATCGAGCTGCCCGAG
AAGGAGAGCTGGACCGTGAACGACATCCAGAAGCTGGTGGGCAAGCTGAACTGGGCCAGCCAGATCTAC
CCCGGCATCAAGGTGCGCCAGCTGTGCAAGCTGCTGCGCGGCGCCAAGGCCCTGACCGACATCGTGCCC
CTGACCGAGGAGGCCGAGCTGGAGCTGGCCGAGAACCGCGAGATCCTGCGCGAGCCCGTGCACGGCGTG
TACTACGACCCCAGCAAGGACCTGGTGGCCGAGATCCAGAAGCAGGGCACGACCAGTGGACCTACCAG
ATCTACCAGGAGCCCTTCAAGAACCTGAAGACCGGCAAGTACGCCAAGATGCGCACCGCCCACACCAAC
GACGTGAAGCAGCTGACCGAGGCCGTGCAGAAGATCGCCATGGAGAGCATCGTGATCTGGGGCAAGACC
CCCAAGTTCCGCCTGCCCATCCAGAAGGAGACCTGGGAGACCTGGTGGACCGACTACTGGCAGGCCACC
TGGATCCCCGAGTGGGAGTTCGTGAACACCCCCCCCCTGGTGAAGCTGTGGTACCAGCTGGAGAAGGAG
CCCATCATCGGCGCCGAGACCTTCTACGTGGACGGCGCCGCCAACCGCGAGACCAAGATCGGCAAGGCC
GGCTACGTGACCGACCGGGCCGGCAGAAGATCGTGAGCCTGACCGAGACCACCAACCAGAAGACCGAG
CTGCAGGCCATCCAGCTGGCCCTGCAGGACAGCGGCAGCGAGGTGAACATCGTGACCGACAGCCAGTAC
GCCCTGGGCATCATCCAGGCCCAGCCCGACAAGAGCGAGAGCGAGCTGGTGAACCAGATCATCGAGCAG
CTGATCAAGAAGGAGAAGGTGTACCTGAGCTGGGTGCCCGCCCACAAGGGCATCGGCGGCAACGAGCAG
ATCGACAAGCTGGTGAGCAAGGGCATCCGCAAGGTGCTC
```

protInaRT.YMWM.opt_C

```
CCCCAGATCACCCTGTGGCAGCGCCCCCTGGTGAGCATCAAGGTGGGCGGCCAGATCAAGGAGGCCCTG
CTGGCCACCGGCGCCGACGACACCGTGCTGGAGGAGATGAGCCTGCCCGGCAAGTGGAAGCCCAAGATG
ATCGGCGGCATCGGCGGCTTCATCAAGGTGCGCCAGTACGACCAGATCCTGATCGAGATCTGCGGCAAG
AAGGCCATCGGCACCGTGCTGATCGGCCCCACCCCCGTGAACATCATCGGCCGCAACATGCTGACCCAG
CTGGGCTGCACCCTGAACTTCCCCATCAGCCCCATCGAGACCGTGCCCGTGAAGCTGAAGCCCGGCATG
GACGGCCCCAAGGTGAAGCAGTGGCCCCTGACCGAGGAGAAGATCAAGGCCCTGACCGCCATCTGCGAG
GAGATGGAGAAGGAGGGCAAGATCACCAAGATCGGCCCCGAGAACCCCTACAACACCCCCGTGTTCGCC
ATCAAGAAGAAGGACAGCACCAAGTGGCGCAAGCTGGTGGACTTCCGCGAGCTGAACAAGCGCACCCAG
GACTTCTGGGAGGTGCAGCTGGGCATCCCCCACCCCGCCGGCCTGAAGAAGAAGAAGAGCGTGACCGTG
CTGGACGTGGGCGACGCCTACTTCAGCGTGCCCCTGGACGAGGACTTCCGCAAGTACACCGCCTTCACC
ATCCCCAGCATCAACAACGAGACCCCCGGCATCCGCTACCAGTACAACGTGCTGCCCCAGGGCTGGAAG
GGCAGCCCCAGCATCTTCCAGAGCAGCATGACCAAGATCCTGGAGCCCTTCCGCGCCCGCAACCCCGAG
ATCGTGATCTACCAGGCCCCCCTGTACGTGGGCAGCGACCTGGAGATCGGCCAGCACCGCGCCAAGATC
GAGGAGCTGCGCAAGCACCTGCTGCGCTGGGGCTTCACCACCCCCGACAAGAAGCACCAGAAGGAGCCC
CCCTTCCTGCCCATCGAGCTGCACCCCGACAAGTGGACCGTGCAGCCCATCGAGCTGCCCGAGAAGGAG
AGCTGGACCGTGAACGACATCCAGAAGCTGGTGGGCAAGCTGAACTGGGCCAGCCAGATCTACCCCGGC
ATCAAGGTGCGCCAGCTGTGCAAGCTGCTGCGCGGCGCCAAGGCCCTGACCGACATCGTGCCCCTGACC
GAGGAGGCCGAGCTGGAGCTGGCCGAGAACCGCGAGATCCTGCGCGAGCCCGTGCACGGCGTGTACTAC
GACCCCAGCAAGGACCTGGTGGCCGAGATCCAGAAGCAGGGCCACGACCAGTGGACCTACCAGATCTAC
CAGGAGCCCTTCAAGAACCTGAAGACCGGCAAGTACGCCAAGATGCGCACCGCCCACACCAACGACGTG
AAGCAGCTGACCGAGGCCGTGCAGAAGATCGCCATGGAGAGCATCGTGATCTGGGGCAAGACCCCCAAG
TTCCGCCTGCCCATCCAGAAGGAGACCTGGGAGACCTGGTGGACCGACTACTGGCAGGCCACCTGGATC
CCCGAGTGGGAGTTCGTGAACACCCCCCCCTGGTGAAGCTGTGGTACCAGCTGGAGAAGGAGCCCATC
ATCGGCGCCGAGACCTTCTACGTGGACGGCGCCGCCAACCGCGAGACCAAGATCGGCAAGGCCGGCTAC
GTGACCGACCGGGCCGGCAGAAGATCGTGAGCCTGACCGAGACCACCAACCAGAAGACCGAGCTGCAG
GCCATCCAGCTGGCCCTGCAGGACAGCGGCAGCGAGGTGAACATCGTGACCGACAGCCAGTACGCCCTG
GGCATCATCCAGGCCCAGCCCGACAAGAGCGAGAGCGAGCTGGTGAACCAGATCATCGAGCAGCTGATC
AAGAAGGAGAAGGTGTACCTGAGCTGGGTGCCCGCCCACAAGGGCATCGGCGGCAACGAGCAGATCGAC
AAGCTGGTGAGCAAGGGCATCCGCAAGGTGCTC
```

ProtRT.TatRevNef.opt_C

```
GCCACCATGCCCCAGATCACCCTGTGGCAGCGCCCCCTGGTGAGCATCAAGGTGGGCGGCCAGATCAAG
GAGGCCCTGCTGGACACCGGCGCCGACGACACCGTGCTGGAGGAGATGAGCCTGCCCGGCAAGTGGAAG
CCCAAGATGATCGGCGGCATCGGCGGCTTCATCAAGGTGCGCCAGTACGACCAGATCCTGATCGAGATC
TGCGGCAAGAAGGCCATCGGCACCGTGCTGATCGGCCCCACCCCCGTGAACATCATCGGCCGCAACATG
CTGACCCAGCTGGGCTGCACCCTGAACTTCCCCATCAGCCCCATCGAGACCGTGCCCGTGAAGCTGAAG
CCCGGCATGGACGGCCCCAAGGTGAAGCAGTGGCCCCTGACCGAGGAGAAGATCAAGGCCCTGACCGCC
ATCTGCGAGGAGATGGAGAAGGAGGGCAAGATCACCAAGATCGGCCCCGAGAACCCCTACAACACCCCC
GTGTTCGCCATCAAGAAGAAGGACAGCACCAAGTGGCGCAAGCTGGTGGACTTCCGCGAGCTGAACAAG
CGCACCCAGGACTTCTGGGAGGTGCAGCTGGGCATCCCCACCCCGCCGGCCTGAAGAAGAAGAAGAGC
GTGACCGTGCTGGACGTGGGCGACGCCTACTTCAGCGTGCCCCTGGACGAGGACTTCCGCAAGTACACC
GCCTTCACCATCCCCAGCATCAACAACGAGACCCCCGGCATCCGCTACCAGTACAACGTGCTGCCCCAG
GGCTGGAAGGGCAGCCCCAGCATCTTCCAGAGCAGCATGACCAAGATCCTGGAGCCCTTCCGCGCCCGC
AACCCCGAGATCGTGATCTACCAGGCCCCCCTGTACGTGGGCAGCGACCTGGAGATCGGCCAGCACCGC
GCCAAGATCGAGGAGCTGCGCAAGCACCTGCTGCGCTGGGGCTTCACCACCCCCGACAAGAAGCACCAG
AAGGAGCCCCCCTTCCTGCCCATCGAGCTGCACCCCGACAAGTGGACCGTGCAGCCCATCGAGCTGCCC
GAGAAGGAGAGCTGGACCGTGAACGACATCCAGAAGCTGGTGGGCAAGCTGAACTGGGCCAGCCAGATC
TACCCCGGCATCAAGGTGCGCCAGCTGTGCAAGCTGCTGCGCGGCGCCAAGGCCCTGACCGACATCGTG
CCCCTGACCGAGGAGGCCGAGCTGGAGCTGGCCGAGAACCGCGAGATCCTGCGCGAGCCCGTGCACGGC
GTGTACTACGACCCCAGCAAGGACCTGGTGGCCGAGATCCAGAAGCAGGGCCACGACCAGTGGACCTAC
CAGATCTACCAGGAGCCCTTCAAGAACCTGAAGACCGGCAAGTACGCCAAGATGCGCACCGCCCACACC
AACGACGTGAAGCAGCTGACCGAGGCCGTGCAGAAGATCGCCATGGAGAGCATCGTGATCTGGGGCAAG
ACCCCCAAGTTCCGCCTGCCCATCCAGAAGGAGACCTGGGAGACCTGGTGGACCGACTACTGGCAGGCC
ACCTGGATCCCCGAGTGGGAGTTCGTGAACACCCCCCCCTGGTGAAGCTGTGGTACCAGCTGGAGAAG
GAGCCCATCATCGGCGCCGAGACCTTCTACGTGGACGGCGCCGCCAACCGCGAGACCAAGATCGGCAAG
GCCGGCTACGTGACCGACCGGGGCCGGCAGAAGATCGTGAGCCTGACCGAGACCACCAACCAGAAGACC
GAGCTGCAGGCCATCCAGCTGGCCCTGCAGGACAGCGGCAGCGAGGTGAACATCGTGACCGACAGCCAG
TACGCCCTGGGCATCATCCAGGCCCAGCCCGACAAGAGCGAGAGCGAGCTGGTGAACCAGATCATCGAG
CAGCTGATCAAGAAGGAGAAGGTGTACCTGAGCTGGGTGCCCGCCCACAAGGGCATCGGCGGCAACGAG
CAGATCGACAAGCTGGTGAGCAAGGGCATCCGCAAGGTGCTCGAATTCGAGCCCGTGGACCCCAACCTG
GAGCCCTGGAACCACCCCGGCAGCCAGCCCAAGACCGCCGGCAACAAGTGCTACTGCAAGCACTGCAGC
TACCACTGCCTGGTGAGCTTCCAGACCAAGGGCCTGGGCATCAGCTACGGCCGCAAGAAGCGCCGCCAG
CGCCGCAGCGCCCCCCCCAGCAGCGAGGACCACCAGAACCCCATCAGCAAGCAGCCCCCTGCCCCAGACC
CGCGGCGACCCCACCGGCAGCGAGGAGAGCAAGAAGAAGGTGGAGAGCAAGACCGAGACCGACCCCTTC
GACCCCGGGGCCGGCCGCAGCGGCGACAGCGACGAGGCCCTGCTGCAGGCCGTGCGCATCATCAAGATC
CTGTACCAGAGCAACCCCTACCCCAAGCCCGAGGGCACCCGCCAGGCCGACCTGAACCGCCGCCGCCGC
TGGCGCGCCCGCCAGCGCCAGATCCACAGCATCAGCGAGCGCATCCTGAGCACCTGCCTGGGCCGCCCC
GCCGAGCCCGTGCCCTTCCAGCTGCCCCCGACCTGCGCCTGCACATCGACTGCAGCGAGAGCAGCGGC
ACCAGCGGCACCCAGCAGAGCCAGGGCACCACCGAGGGCGTGGGCAGCCCCCTCGAGGCCGGCAAGTGG
AGCAAGAGCAGCATCGTGGGCTGGCCCGCCGTGCGCGAGCGCATCCGCCGCACCGAGCCCGCCGCCGAG
GGCGTGGGCGCCGCCAGCCAGGACCTGGACAAGCACGGCGCCCTGACCAGCAGCAACACCGCCGCCAAC
AACGCCGACTGCGCCTGGCTGGAGGCCCAGGAGGAGGAGGAGGAGGTGGGCTTCCCCGTGCGCCCCCAG
GTGCCCCTGCGCCCCATGACCTACAAGGCCGCCTTCGACCTGAGCTTCTTCCTGAAGGAGAAGGGCGGC
CTGGAGGGCCTGATCTACAGCAAGAAGCGCCAGGAGATCCTGGACCTGTGGGTGTACCACACCCAGGGC
TTCTTCCCCGGCTGGCAGAACTACACCCCCGGCCCCGGCGTGCGCTACCCCCTGACCTTCGGCTGGTGC
TTCAAGCTGGTGCCCGTGGACCCCGCGAGGTGGAGGAGGCCAACAAGGGCGAGAACAACTGCCTGCTG
CACCCCATGAGCCAGCACGGCATGGAGGACGAGGACCGCGAGGTGCTGAAGTGGAAGTTCGACAGCAGC
CTGGCCCGCCGCCACATGGCCCGCGAGCTGCACCCCGAGTACTACAAGGACTGCGCCTAA
```

rev.exon1_2.M5/10.opt_C

```
ATGGCCGGCCGCAGCGGCGACAGCGACGAGGCCCTGCTGCAGGCCGTGCGCATCATCAAGATCCTGTAC
CAGAGCAACCCCTACCCCAAGCCCGAGGGCACCCGCCAGGCCGACCTGAACCGCCGCCGCCGCTGGCGC
GCCCGCCAGCGCCAGATCCACAGCATCAGCGAGCGCATCCTGAGCACCTGCCTGGGCCGCCCCGCCGAG
CCCGTGCCCTTCCAGCTGCCCCCCGACCTGCGCCTGCACATCGACTGCAGCGAGAGCAGCGGCACCAGC
GGCACCCAGCAGAGCCAGGGCACCACCGAGGGCGTGGGCAGCCCC
```

tat.exon1_2.opt.C22/37_C

```
ATGGAGCCCGTGGACCCCAACCTGGAGCCCTGGAACCACCCCGGCAGCCAGCCCAAGACCGCCGGCAAC
AAGTGCTACTGCAAGCACTGCAGCTACCACTGCCTGGTGAGCTTCCAGACCAAGGGCCTGGGCATCAGC
TACGGCCGCAAGAAGCGCCGCCAGCGCCGCAGCGCCCCCCCCAGCAGCGAGGACCACCAGAACCCCATC
AGCAAGCAGCCCCTGCCCCAGACCCGCGGCGACCCCACCGGCAGCGAGGAGAGCAAGAAGAAGGTGGAG
AGCAAGACCGAGACCGACCCCTTCGAC
```

tat.exon1_2.opt.C37_C

ATGGAGCCCGTGGACCCCAACCTGGAGCCCTGGAACCACCCCGGCAGCCAGCCCAAGACCGCCTGCAAC
AAGTGCTACTGCAAGCACTGCAGCTACCACTGCCTGGTGAGCTTCCAGACCAAGGGCCTGGGCATCAGC
TACGGCCGCAAGAAGCGCCGCCAGCGCCGCAGCGCCCCCCCCAGCAGCGAGGACCACCAGAACCCCATC
AGCAAGCAGCCCCTGCCCCAGACCCGCGGCGACCCCACCGGCAGCGAGGAGAGCAAGAAGAAGGTGGAG
AGCAAGACCGAGACCGACCCCTTCGAC

TatRevNef.opt.native_ZA

ATGGAGCCCGTGGACCCCAACCTGGAGCCCTGGAACCACCCCGGCAGCCAGCCCAAGACCGCCTGCAAC
AAGTGCTACTGCAAGCACTGCAGCTACCACTGCCTGGTGTGCTTCCAGACCAAGGGCCTGGGCATCAGC
TACGGCCGCAAGAAGCGCCGCCAGCGCCGCAGCGCCCCCCCCAGCAGCGAGGACCACCAGAACCCCATC
AGCAAGCAGCCCCTGCCCCAGACCCGCGGCGACCCCACCGGCAGCGAGGAGAGCAAGAAGAAGGTGGAG
AGCAAGACCGAGACCGACCCCTTCGACCCCGGGGCCGGCCGCAGCGGCGACAGCGACGAGGCCCTGCTG
CAGGCCGTGCGCATCATCAAGATCCTGTACCAGAGCAACCCCTACCCCAAGCCCGAGGGCACCCGCCAG
GCCCGCAAGAACCGCCGCCGCCGCTGGCGCGCCCGCCAGCGCCAGATCCACAGCATCAGCGAGCGCATC
CTGAGCACCTGCCTGGGCCGCCCCGCCGAGCCCGTGCCCTTCCAGCTGCCCCCCATCGAGCGCCTGCAC
ATCGACTGCAGCGAGAGCAGCGGCACCAGCGGCACCCAGCAGAGCCAGGGCACCACCGAGGGCGTGGGC
AGCCCCCTCGAGGGCGGCAAGTGGAGCAAGAGCAGCATCGTGGGCTGGCCCGCCGTGCGCGAGCGCATC
CGCCGCACCGAGCCCGCCCGCGAGGGCGCCGCCGAGGGCGCCGCCGAGGGCGTGGGCGCCGCCAGCCAG
GACCTGGACAAGCACGGCGCCCTGACCAGCAGCAACACCGCCGCCAACAACGCCGACTGCGCCTGGCTG
GAGGCCCAGGAGGAGGAGGAGGAGGTGGGCTTCCCCGTGCGCCCCCAGGTGCCCCTGCGCCCCATGACC
TACAAGGCCGCCTTCGACCTGAGCTTCTTCCTGAAGGAGAAGGGCGGCCTGGAGGGCCTGATCTACAGC
AAGAAGCGCCAGGAGATCCTGGACCTGTGGGTGTACCACACCCAGGGCTTCTTCCCCGACTGGCAGAAC
TACACCCCCGGCCCCGGCGTGCGCTACCCCCTGACCTTCGGCTGGTGCTTCAAGCTGGTGCCCGTGGAC
CCCCGCGAGGTGGAGGAGGCCAACAAGGGCGAGAACAACTGCCTGCTGCACCCCATGAGCCAGCACGGC
ATGGAGGACGAGGACCGCGAGGTGCTGAAGTGGAAGTTCGACAGCAGCCTGGCCCGCCGCCACATGGCC
CGCGAGCTGCACCCCGAGTACTACAAGGACTGC

TatRevNef.opt_ZA

```
ATGGAGCCCGTGGACCCCAACCTGGAGCCCTGGAACCACCCCGGCAGCCAGCCCAAGACCGCCGGCAAC
AAGTGCTACTGCAAGCACTGCAGCTACCACTGCCTGGTGAGCTTCCAGACCAAGGGCCTGGGCATCAGC
TACGGCCGCAAGAAGCGCCGCCAGCGCCGCAGCGCCCCCCCCAGCAGCGAGGACCACCAGAACCCCATC
AGCAAGCAGCCCCTGCCCCAGACCCGCGGCGACCCCACCGGCAGCGAGGAGAGCAAGAAGAAGGTGGAG
AGCAAGACCGAGACCGACCCCTTCGACCCCGGGGCCGGCCGCAGCGGCGACAGCGACGAGGCCCTGCTG
CAGGCCGTGCGCATCATCAAGATCCTGTACCAGAGCAACCCCTACCCCAAGCCCGAGGGCACCCGCCAG
GCCGACCTGAACCGCCGCCGCCGCTGGCGCGCCCGCCAGCGCCAGATCCACAGCATCAGCGAGCGCATC
CTGAGCACCTGCCTGGGCCGCCCCGCCGAGCCCGTGCCCTTCCAGCTGCCCCCCGACCTGCGCCTGCAC
ATCGACTGCAGCGAGAGCAGCGGCACCAGCGGCACCCAGCAGAGCCAGGGCACCACCGAGGGCGTGGGC
AGCCCCCTCGAGGCCGGCAAGTGGAGCAAGAGCAGCATCGTGGGCTGGCCCGCCGTGCGCGAGCGCATC
CGCCGCACCGAGCCCGCCGCCGAGGGCGTGGGCGCCGCCAGCCAGGACCTGGACAAGCACGGCGCCCTG
ACCAGCAGCAACACCGCCGCCAACAACGCCGACTGCGCCTGGCTGGAGGCCCAGGAGGAGGAGGAGGAG
GTGGGCTTCCCCGTGCGCCCCCAGGTGCCCCTGCGCCCCATGACCTACAAGGCCGCCTTCGACCTGAGC
TTCTTCCTGAAGGAGAAGGGCGGCCTGGAGGGCCTGATCTACAGCAAGAAGCGCCAGGAGATCCTGGAC
CTGTGGGTGTACCACACCCAGGGCTTCTTCCCCGGCTGGCAGAACTACACCCCCGGCCCCGGCGTGCGC
TACCCCCTGACCTTCGGCTGGTGCTTCAAGCTGGTGCCCGTGGACCCCCGCGAGGTGGAGGAGGCCAAC
AAGGGCGAGAACAACTGCCTGCTGCACCCCATGAGCCAGCACGGCATGGAGGACGAGGACCGCGAGGTG
CTGAAGTGGAAGTTCGACAGCAGCCTGGCCCGCCGCCACATGGCCCGCGAGCTGCACCCCGAGTACTAC
AAGGACTGCGCCTAA
```

TatRevNefGag_C

```
GCCACCATGGAGCCCGTGGACCCCAACCTGGAGCCCTGGAACCACCCCGGCAGCCAGCCCAAGACCGCC
GGCAACAAGTGCTACTGCAAGCACTGCAGCTACCACTGCCTGGTGAGCTTCCAGACCAAGGGCCTGGGC
ATCAGCTACGGCCGCAAGAAGCGCCGCCAGCGCCGCAGCGCCCCCCCCAGCAGCGAGGACCACCAGAAC
CCCATCAGCAAGCAGCCCCTGCCCCAGACCCGCGGCGACCCCACCGGCAGCGAGGAGAGCAAGAAGAAG
GTGGAGAGCAAGACCGAGACCGACCCCTTCGACCCCGGGGCCGGCCGCAGCGGCGACAGCGACGAGGCC
CTGCTGCAGGCCGTGCGCATCATCAAGATCCTGTACCAGAGCAACCCCTACCCCAAGCCCGAGGGCACC
CGCCAGGCCGACCTGAACCGCCGCCGCCGCTGGCGCGCCCGCCAGCGCCAGATCCACAGCATCAGCGAG
CGCATCCTGAGCACCTGCCTGGGCCGCCCCGCCGAGCCCGTGCCCTTCCAGCTGCCCCCCGACCTGCGC
CTGCACATCGACTGCAGCGAGAGCAGCGGCACCAGCGGCACCCAGCAGAGCCAGGGCACCACCGAGGGC
GTGGGCAGCCCCTCGAGGCCGGCAAGTGGAGCAAGAGCAGCATCGTGGGCTGGCCCGCCGTGCGCGAG
CGCATCCGCCGCACCGAGCCCGCCGCCGAGGGCGTGGGCGCCGCCAGCCAGGACCTGGACAAGCACGGC
GCCCTGACCAGCAGCAACACCGCCGCCAACAACGCCGACTGCGCCTGGCTGGAGGCCCAGGAGGAGGAG
GAGGAGGTGGGCTTCCCCGTGCGCCCCAGGTGCCCCTGCGCCCCATGACCTACAAGGCCGCCTTCGAC
CTGAGCTTCTTCCTGAAGGAGAAGGGCGGCCTGGAGGGCCTGATCTACAGCAAGAAGCGCCAGGAGATC
CTGGACCTGTGGGTGTACCACACCCAGGGCTTCTTCCCCGGCTGGCAGAACTACACCCCCGGCCCCGGC
GTGCGCTACCCCCTGACCTTCGGCTGGTGCTTCAAGCTGGTGCCCGTGGACCCCGCGAGGTGGAGGAG
GCCAACAAGGGCGAGAACAACTGCCTGCTGCACCCCATGAGCCAGCACGGCATGGAGGACGAGGACCGC
GAGGTGCTGAAGTGGAAGTTCGACAGCAGCCTGGCCCGCCGCCACATGGCCCGCGAGCTGCACCCCGAG
TACTACAAGGACTGCGAATTCGGCGCCCGCGCCAGCATCCTGCGCGGCGGCAAGCTGGACGCCTGGGAG
CGCATCCGCCTGCGCCCCGGCGGCAAGAAGTGCTACATGATGAAGCACCTGGTGTGGGCCAGCCGCGAG
CTGGAGAAGTTCGCCCTGAACCCCGGCCTGCTGGAGACCAGCGAGGGCTGCAAGCAGATCATCCGCCAG
CTGCACCCCGCCCTGCAGACCGGCAGCGAGGAGCTGAAGAGCCTGTTCAACACCGTGGCCACCCTGTAC
TGCGTGCACGAGAAGATCGAGGTCCGCGACACCAAGGAGGCCCTGGACAAGATCGAGGAGGAGCAGAAC
AAGTGCCAGCAGAAGATCCAGCAGGCCGAGGCCGCCGACAAGGGCAAGGTGAGCCAGAACTACCCCATC
GTGCAGAACCTGCAGGGCCAGATGGTGCACCAGGCCATCAGCCCCGCACCCTGAACGCCTGGGTGAAG
GTGATCGAGGAGAAGGCCTTCAGCCCCGAGGTGATCCCCATGTTCACCGCCCTGAGCGAGGGCGCCACC
CCCCAGGACCTGAACACGATGTTGAACACCGTGGGCGGCCACCAGGCCGCCATGCAGATGCTGAAGGAC
ACCATCAACGAGGAGGCCGCCGAGTGGGACCGCGTGCACCCCGTGCACGCCGGCCCCATCGCCCCCGGC
CAGATGCGCGAGCCCCGCGGCAGCGACATCGCCGGCACCACCAGCACCCTGCAGGAGCAGATCGCCTGG
ATGACCAGCAACCCCCCCATCCCCGTGGGCGACATCTACAAGCGGTGGATCATCCTGGGCCTGAACAAG
ATCGTGCGGATGTACAGCCCCGTGAGCATCCTGGACATCAAGCAGGGCCCCAAGGAGCCCTTCCGCGAC
TACGTGGACCGCTTCTTCAAGACCCTGCGCGCCGAGCAGAGCACCCAGGAGGTGAAGAACTGGATGACC
GACACCCTGCTGGTGCAGAACGCCAACCCCGACTGCAAGACCATCCTGCGCGCTCTCGGCCCCGGCGCC
AGCCTGGAGGAGATGATGACCGCCTGCCAGGGCGTGGGCGGCCCCAGCCACAAGGCCCGCGTGCTGGCC
GAGGCGATGAGCCAGGCCAACACCAGCGTGATGATGCAGAAGAGCAACTTCAAGGGCCCCCGGCGCATC
GTCAAGTGCTTCAACTGCGGCAAGGAGGGCCACATCGCCCGCAACTGCCGCGCCCCCGCAAGAAGGGC
TGCTGGAAGTGCGGCAAGGAGGGCCACCAGATGAAGGACTGCACCGAGCGCCAGGCCAACTTCCTGGGC
AAGATCTGGCCCAGCCACAAGGGCCGCCCCGGCAACTTCCTGCAGAGCCGCCCCGAGCCCACCGCCCCC
CCCGCCGAGAGCTTCCGCTTCGAGGAGACCACCCCCGGCCAGAAGCAGGAGAGCAAGGACCGCGAGACC
CTGACCAGCCTGAAGAGCCTGTTCGGCAACGACCCCCTGAGCCAAGCCTAA
```

Figure 55A

```
TatRevNefgagCpolIna_C

GCCACCATGGAGCCCGTGGACCCCAACCTGGAGCCCTGGAACCACCCCGGCAGCCAGCCCAAGACCGCCGGCAAC
AAGTGCTACTGCAAGCACTGCAGCTACCACTGCCTGGTGAGCTTCCAGACCAAGGGCCTGGGCATCAGCTACGGC
CGCAAGAAGCGCCGCCAGCGCCGCAGCGCCCCCCCCAGCAGCGAGGACCACCAGAACCCCATCAGCAAGCAGCCC
CTGCCCCAGACCCGCGGCGACCCCACCGGCAGCGAGGAGAGCAAGAAGAAGGTGGAGAGCAAGACCGAGACCGAC
CCCTTCGACCCCGGGGCCGGCCGCAGCGGCGACAGCGACGAGGCCCTGCTGCAGGCCGTGCGCATCATCAAGATC
CTGTACCAGAGCAACCCCTACCCCAAGCCCGAGGGCACCCGCCAGGCCGACCTGAACCGCCGCCGCCGCTGGCGC
GCCCGCCAGCGCCAGATCCACAGCATCAGCGAGCGCATCCTGAGCACCTGCCTGGGCCGCCCCGCCGAGCCCGTG
CCCTTCCAGCTGCCCCCCGACCTGCGCCTGCACATCGACTGCAGCGAGAGCAGCGGCACCAGCGGCACCCAGCAG
AGCCAGGGCACCACCGAGGGCGTGGGCAGCCCCTCGAGGCCGGCAAGTGGAGCAAGAGCAGCATCGTGGGCTGG
CCCGCCGTGCGCGAGCGCATCCGCCGCACCGAGCCCGCCGCCGAGGGCGTGGGCGCCGCCAGCCAGGACCTGGAC
AAGCACGGCGCCCTGACCAGCAGCAACACCGCCGCCAACAACGCCGACTGCGCCTGGCTGGAGGCCCAGGAGGAG
GAGGAGGAGGTGGGCTTCCCCGTGCGCCCCCAGGTGCCCCTGCGCCCCATGACCTACAAGGCCGCCTTCGACCTG
AGCTTCTTCCTGAAGGAGAAGGGCGGCCTGGAGGGCCTGATCTACAGCAAGAAGCGCCAGGAGATCCTGGACCTG
TGGGTGTACCACACCCAGGGCTTCTTCCCCGGCTGGCAGAACTACACCCCCGGCCCCGGCGTGCGCTACCCCCTG
ACCTTCGGCTGGTGCTTCAAGCTGGTGCCCGTGGACCCCGCGAGGTGGAGGAGGCCAACAAGGGCGAGAACAAC
TGCCTGCTGCACCCCATGAGCCAGCACGGCATGGAGGACGAGGACCGCGAGGTGCTGAAGTGGAAGTTCGACAGC
AGCCTGGCCCGCCGCCACATGGCCCGCGAGCTGCACCCCGAGTACTACAAGGACTGCCTCGAGGGCGCCCGCGCC
AGCATCCTGCGCGGCGGCAAGCTGGACGCCTGGGAGCGCATCCGCCTGCGCCCCGGCGGCAAGAAGTGCTACATG
ATGAAGCACCTGGTGTGGGCCAGCCGCGAGCTGGAGAAGTTCGCCCTGAACCCCGGCCTGCTGGAGACCAGCGAG
GGCTGCAAGCAGATCATCCGCCAGCTGCACCCCGCCCTGCAGACCGGCAGCGAGGAGCTGAAGAGCCTGTTCAAC
ACCGTGGCCACCCTGTACTGCGTGCACGAGAAGATCGAGGTCCGCGACACCAAGGAGGCCCTGGACAAGATCGAG
GAGGAGCAGAACAAGTGCCAGCAGAAGATCCAGCAGGCCGAGGCCGCCGACAAGGGCAAGGTGAGCCAGAACTAC
CCCATCGTGCAGAACCTGCAGGGCCAGATGGTGCACCAGGCCATCAGCCCCCGCACCCTGAACGCCTGGGTGAAG
GTGATCGAGGAGAAGGCCTTCAGCCCCGAGGTGATCCCCATGTTCACCGCCCTGAGCGAGGGCGCCACCCCCCAG
GACCTGAACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAGCCCCGC
GGCAGCGACATCGCCGGCACCACCAGCACCCTGCAGGAGCAGATCCTGTGGATGACCAGCAACCCCCCCATCCCC
GTGGGCGACATCTACAAGCGGTGGATCATCCTGGGCCTGAACAAGATCGTGCGGATGTACAGCCCCGTGAGCATC
CTGGACATCAAGCAGGGCCCCAAGGAGCCCTTCCGCGACTACGTGGACCGCTTCTTCAAGACCCTGCGCGCCGAG
CAGAGCACCCAGGAGGTGAAGAACTGGATGACCGACACCCTGCTGGTGCAGAACGCCAACCCCGACTGCAAGACC
ATCCTGCGCGCTCTCGGCCCCGGCGCCAGCCTGGAGGAGATGATGACCGCCTGCCAGGGCGTGGGCGGCCCCAGC
CACAAGGCCCGCGTGCTGGCCGAGGCGATGAGCCAGGCCAACACCAGCGTGATGATGCAGAAGAGCAACTTCAAG
GGCCCCCGGCGCATCGTCAAGTGCTTCAACTGCGGCAAGGAGGGCCACATCGCCCGCAACTGCCGCGCCCCCCGC
AAGAAGGGCTGCTGGAAGTGCGGCAAGGAGGGCCACCAGATGAAGGACTGCACCGAGCGCCAGGCCAACTTCCTG
GGCAAGATCTGGCCCAGCCACAAGGGCCGCCCCGGCAACTTCCTGCAGAGCCGCCCCGAGCCCACCGCCCCCCCC
GCCGAGAGCTTCCGCTTCGAGGAGACCACCCCCGGCCAGAAGCAGGAGAGCAAGGACCGCGAGACCCTGACCAGC
CTGAAGAGCCTGTTCGGCAACGACCCCCTGAGCCAAGAATTCGCCGAGGCCATGAGCCAGGCCACCAGCGCCAAC
ATCCTGATGCAGCGCAGCAACTTCAAGGGCCCCAAGCGCATCATCAAGTGCTTCAACTGCGGCAAGGAGGGCCAC
ATCGCCCGCAACTGCCGCGCCCCCCGCAAGAAGGGCTGCTGGAAGTGCGGCAAGGAGGGCCACCAGATGAAGGAC
TGCACCGAGCGCCAGGCCAACTTCTTCCGCGAGGACCTGGCCTTCCCCCAGGGCAAGGCCCGCGAGTTCCCCAGC
GAGCAGAACCGCGCCAACAGCCCCACCAGCCGCGAGCTGCAGGTGCGCGGCGACAACCCCCGCAGCGAGGCCGGC
GCCGAGCGCCAGGGCACCCTGAACTTCCCCCAGATCACCCTGTGGCAGCGCCCCCTGGTGAGCATCAAGGTGGGC
GGCCAGATCAAGGAGGCCCTGCTGGCCACCGGCGCCGACGACACCGTGCTGGAGGAGATGAGCCTGCCCGGCAAG
TGGAAGCCCAAGATGATCGGCGGCATCGGCGGCTTCATCAAGGTGCGCCAGTACGACCAGATCCTGATCGAGATC
TGCGGCAAGAAGGCCATCGGCACCGTGCTGATCGGCCCCACCCCCGTGAACATCATCGGCCGCAACATGCTGACC
CAGCTGGGCTGCACCCTGAACTTCCCCATCAGCCCCATCGAGACCGTGCCCGTGAAGCTGAAGCCCGGCATGGAC
GGCCCCAAGGTGAAGCAGTGGCCCCTGACCGAGGAGAAGATCAAGGCCCTGACCGCCATCTGCGAGGAGATGGAG
AAGGAGGGCAAGATCACCAAGATCGGCCCCGAGAACCCCTACAACACCCCCGTGTTCGCCATCAAGAAGAAGGAC
AGCACCAAGTGGCGCAAGCTGGTGGACTTCCGCGAGCTGAACAAGCGCACCCAGGACTTCTGGGAGGTGCAGCTG
GGCATCCCCCACCCCGCCGGCCTGAAGAAGAAGAAGAGCGTGACCGTGCTGGACGTGGGCGACGCCTACTTCAGC
GTGCCCCTGGACGAGGACTTCCGCAAGTACACCGCCTTCACCATCCCCAGCATCAACAACGAGACCCCCGGCATC
CGCTACCAGTACAACGTGCTGCCCCAGGGCTGGAAGGGCAGCCCCAGCATCTTCCAGAGCAGCATGACCAAGATC
CTGGAGCCCTTCCGCGCCCGCAACCCCGAGATCGTGATCTACCAGGCCCCCCTGTACGTGGGCAGCGACCTGGAG
ATCGGCCAGCACCGCGCCAAGATCGAGGAGCTGCGCAAGCACCTGCTGCGCTGGGGCTTCACCACCCCCGACAAG
AAGCACCAGAAGGAGCCCCCCTTCCTGCCCATCGAGCTGCACCCCGACAAGTGGACCGTGCAGCCCATCGAGCTG
CCCGAGAAGGAGAGCTGGACCGTGAACGACATCCAGAAGCTGGTGGGCAAGCTGAACTGGGCCAGCCAGATCTAC
```

Figure 55B

```
CCCGGCATCAAGGTGCGCCAGCTGTGCAAGCTGCTGCGCGGCGCCAAGGCCCTGACCGACATCGTGCCCCTGACC
GAGGAGGCCGAGCTGGAGCTGGCCGAGAACCGCGAGATCCTGCGCGAGCCCGTGCACGGCGTGTACTACGACCCC
AGCAAGGACCTGGTGGCCGAGATCCAGAAGCAGGGCCACGACCAGTGGACCTACCAGATCTACCAGGAGCCCTTC
AAGAACCTGAAGACCGGCAAGTACGCCAAGATGCGCACCGCCCACACCAACGACGTGAAGCAGCTGACCGAGGCC
GTGCAGAAGATCGCCATGGAGAGCATCGTGATCTGGGGCAAGACCCCCAAGTTCCGCCTGCCCATCCAGAAGGAG
ACCTGGGAGACCTGGTGGACCGACTACTGGCAGGCCACCTGGATCCCCGAGTGGGAGTTCGTGAACACCCCCCCC
CTGGTGAAGCTGTGGTACCAGCTGGAGAAGGAGCCCATCATCGGCGCCGAGACCTTCTACGTGGACGGCGCCGCC
AACCGCGAGACCAAGATCGGCAAGGCCGGCTACGTGACCGACCGGGGCCGGCAGAAGATCGTGAGCCTGACCGAG
ACCACCAACCAGAAGACCGAGCTGCAGGCCATCCAGCTGGCCCTGCAGGACAGCGGCAGCGAGGTGAACATCGTG
ACCGACAGCCAGTACGCCCTGGGCATCATCCAGGCCCAGCCCGACAAGAGCGAGAGCGAGCTGGTGAACCAGATC
ATCGAGCAGCTGATCAAGAAGGAGAAGGTGTACCTGAGCTGGGTGCCCGCCCACAAGGGCATCGGCGGCAACGAG
CAGATCGACAAGCTGGTGAGCAAGGGCATCCGCAAGGTGCTGTTCCTGGACGGCATCGATGGCGGCATCGTGATC
TACCAGTACATGGACGACCTGTACGTGGGCAGCGGCGGCCCTAGGATCGATTAAAAGCTTCCCGGGGCTAGCACC
GGTTCTAGA
```

Figure 56A

TatRevNefGagProtInaRTmut_C

```
GCCACCATGGAGCCCGTGGACCCCAACCTGGAGCCCTGGAACCACCCCGGCAGCCAGCCCAAGACCGCCGGCAAC
AAGTGCTACTGCAAGCACTGCAGCTACCACTGCCTGGTGAGCTTCCAGACCAAGGGCCTGGGCATCAGCTACGGC
CGCAAGAAGCGCCGCCAGCGCCGCAGCGCCCCCCCCAGCAGCGAGGACCACCAGAACCCCATCAGCAAGCAGCCC
CTGCCCCAGACCCGCGGCGACCCCACCGGCAGCGAGGAGAGCAAGAAGAAGGTGGAGAGCAAGACCGAGACCGAC
CCCTTCGACCCCGGGGCCGGCCGCAGCGGCGACAGCGACGAGGCCCTGCTGCAGGCCGTGCGCATCATCAAGATC
CTGTACCAGAGCAACCCCTACCCCAAGCCCGAGGGCACCCGCCAGGCCGACCTGAACCGCCGCCGCCGCTGGCGC
GCCCGCCAGCGCCAGATCCACAGCATCAGCGAGCGCATCCTGAGCACCTGCCTGGGCCGCCCCGCCGAGCCCGTG
CCCTTCCAGCTGCCCCCCGACCTGCGCCTGCACATCGACTGCAGCGAGAGCAGCGGCACCAGCGGCACCCAGCAG
AGCCAGGGCACCACCGAGGGCGTGGGCAGCCCCCTCGAGGCCGGCAAGTGGAGCAAGAGCAGCATCGTGGGCTGG
CCCGCCGTGCGCGAGCGCATCCGCCGCACCGAGCCCGCCGCCGAGGGCGTGGGCGCCGCCAGCCAGGACCTGGAC
AAGCACGGCGCCCTGACCAGCAGCAACACCGCCGCCAACAACGCCGACTGCGCCTGGCTGGAGGCCCAGGAGGAG
GAGGAGGAGGTGGGCTTCCCCGTGCGCCCCCAGGTGCCCCTGCGCCCCATGACCTACAAGGCCGCCTTCGACCTG
AGCTTCTTCCTGAAGGAGAAGGGCGGCCTGGAGGGCCTGATCTACAGCAAGAAGCGCCAGGAGATCCTGGACCTG
TGGGTGTACCACACCCAGGGCTTCTTCCCCGGCTGGCAGAACTACACCCCCGGCCCCGGCGTGCGCTACCCCCTG
ACCTTCGGCTGGTGCTTCAAGCTGGTGCCCGTGGACCCCGCGAGGTGGAGGAGGCCAACAAGGGCGAGAACAAC
TGCCTGCTGCACCCCATGAGCCAGCACGGCATGGAGGACGAGGACCGCGAGGTGCTGAAGTGGAAGTTCGACAGC
AGCCTGGCCCGCCGCCACATGGCCCGCGAGCTGCACCCCGAGTACTACAAGGACTGCAAGCTTGGCGCCCGCGCC
AGCATCCTGCGCGGCGGCAAGCTGGACGCCTGGGAGCGCATCCGCCTGCGCCCCGGCGGCAAGAAGTGCTACATG
ATGAAGCACCTGGTGTGGGCCAGCCGCGAGCTGGAGAAGTTCGCCCTGAACCCCGGCCTGCTGGAGACCAGCGAG
GGCTGCAAGCAGATCATCCGCCAGCTGCACCCCGCCCTGCAGACCGGCAGCGAGGAGCTGAAGAGCCTGTTCAAC
ACCGTGGCCACCCTGTACTGCGTGCACGAGAAGATCGAGGTCGCGACACCAAGGAGGCCCTGGACAAGATCGAG
GAGGAGCAGAACAAGTGCCAGCAGAAGATCCAGCAGGCCGAGGCCGCCGACAAGGGCAAGGTGAGCCAGAACTAC
CCCATCGTGCAGAACCTGCAGGGCCAGATGGTGCACCAGGCCATCAGCCCCCGCACCCTGAACGCCTGGGTGAAG
GTGATCGAGGAGAAGGCCTTCAGCCCCGAGGTGATCCCCATGTTCACCGCCCTGAGCGAGGGCGCCACCCCCCAG
GACCTGAACACGATGTTGAACACCGTGGGCGGCCACCAGGCCGCCATGCAGATGCTGAAGGACACCATCAACGAG
GAGGCCGCCGAGTGGGACCGCGTGCACCCCGTGCACGCCGGCCCCATCGCCCCCGGCCAGATGCGCGAGCCCCGC
GGCAGCGACATCGCCGGCACCACCAGCACCCTGCAGGAGCAGATCGCCTGGATGACCAGCAACCCCCCCATCCCC
GTGGGCGACATCTACAAGCGGTGGATCATCCTGGGCCTGAACAAGATCGTGCGGATGTACAGCCCCGTGAGCATC
CTGGACATCAAGCAGGGCCCCAAGGAGCCCTTCCGCGACTACGTGGACCGCTTCTTCAAGACCCTGCGCGCCGAG
CAGAGCACCCAGGAGGTGAAGAACTGGATGACCGACACCCTGCTGGTGCAGAACGCCAACCCCGACTGCAAGACC
ATCCTGCGCGCTCTCGGCCCCGGCGCCAGCCTGGAGGAGATGATGACCGCCTGCCAGGGCGTGGGCGGCCCCAGC
CACAAGGCCCGCGTGCTGGCCGAGGCGATGAGCCAGGCCAACACCAGCGTGATGATGCAGAAGAGCAACTTCAAG
GGCCCCCGGCGCATCGTCAAGTGCTTCAACTGCGGCAAGGAGGGCCACATCGCCCGCAACTGCCGCGCCCCCCGC
AAGAAGGGCTGCTGGAAGTGCGGCAAGGAGGGCCACCAGATGAAGGACTGCACCGAGCGCCAGGCCAACTTCCTG
GGCAAGATCTGGCCCAGCCACAAGGGCCGCCCCGGCAACTTCCTGCAGAGCCGCCCCGAGCCCACCGCCCCCCCC
GCCGAGAGCTTCCGCTTCGAGGAGACCACCCCCGGCCAGAAGCAGGAGAGCAAGGACCGCGAGACCCTGACCAGC
CTGAAGAGCCTGTTCGGCAACGACCCCCTGAGCCAGAAAGAATTCCCCCAGATCACCCTGTGGCAGCGCCCCCTG
GTGAGCATCAAGGTGGGCGGCCAGATCAAGGAGGCCCTGCTGGCCACCGGCGCCGACGACACCGTGCTGGAGGAG
ATGAGCCTGCCCGGCAAGTGGAAGCCCAAGATGATCGGCGGCATCGGCGGCTTCATCAAGGTGCGCCAGTACGAC
CAGATCCTGATCGAGATCTGCGGCAAGAAGGCCATCGGCACCGTGCTGATCGGCCCCACCCCCGTGAACATCATC
GGCCGCAACATGCTGACCCAGCTGGGCTGCACCCTGAACTTCCCCATCAGCCCCATCGAGACCGTGCCCGTGAAG
CTGAAGCCCGGCATGGACGGCCCCAAGGTGAAGCAGTGGCCCCTGACCGAGGAGAAGATCAAGGCCCTGACCGCC
ATCTGCGAGGAGATGGAGAAGGAGGGCAAGATCACCAAGATCGGCCCCGAGAACCCCTACAACACCCCCGTGTTC
GCCATCAAGAAGAAGGACAGCACCAAGTGGCGCAAGCTGGTGGACTTCCGCGAGCTGAACAAGCGCACCCAGGAC
TTCTGGGAGGTGCAGCTGGGCATCCCCCACCCCGCCGGCCTGAAGAAGAAGAAGAGCGTGACCGTGCTGGACGTG
GGCGACGCCTACTTCAGCGTGCCCCTGGACGAGGACTTCCGCAAGTACACCGCCTTCACCATCCCCAGCATCAAC
AACGAGACCCCCGGCATCCGCTACCAGTACAACGTGCTGCCCCAGGGCTGGAAGGGCAGCCCCAGCATCTTCCAG
AGCAGCATGACCAAGATCCTGGAGCCCTTCCGCGCCCGCAACCCCGAGATCGTGATCTACCAGGCCCCCTGTAC
GTGGGCAGCGACCTGGAGATCGGCCAGCACCGCGCCAAGATCGAGGAGCTGCGCAAGCACCTGCTGCGCTGGGGC
TTCACCACCCCCGACAAGAAGCACCAGAAGGAGCCCCCCTTCCTGCCCATCGAGCTGCACCCCGACAAGTGGACC
GTGCAGCCCATCGAGCTGCCCGAGAAGGAGAGCTGGACCGTGAACGACATCCAGAAGCTGGTGGGCAAGCTGAAC
TGGGCCAGCCAGATCTACCCCGGCATCAAGGTGCGCCAGCTGTGCAAGCTGCTGCGCGGCGCCAAGGCCCTGACC
GACATCGTGCCCCTGACCGAGGAGGCCGAGCTGGAGCTGGCCGAGAACCGCGAGATCCTGCGCGAGCCCGTGCAC
GGCGTGTACTACGACCCCAGCAAGGACCTGGTGGCCGAGATCCAGAAGCAGGGCCACGACCAGTGGACCTACCAG
ATCTACCAGGAGCCCTTCAAGAACCTGAAGACCGGCAAGTACGCCAAGATGCGCACCGCCCACACCAACGACGTG
AAGCAGCTGACCGAGGCCGTGCAGAAGATCGCCATGGAGAGCATCGTGATCTGGGGCAAGACCCCCAAGTTCCGC
```

Figure 56B

```
CTGCCCATCCAGAAGGAGACCTGGGAGACCTGGTGGACCGACTACTGGCAGGCCACCTGGATCCCCGAGTGGGAG
TTCGTGAACACCCCCCCCCTGGTGAAGCTGTGGTACCAGCTGGAGAAGGAGCCCATCATCGGCGCCGAGACCTTC
TACGTGGACGGCGCCGCCAACCGCGAGACCAAGATCGGCAAGGCCGGCTACGTGACCGACCGGGGCCGGCAGAAG
ATCGTGAGCCTGACCGAGACCACCAACCAGAAGACCGAGCTGCAGGCCATCCAGCTGGCCCTGCAGGACAGCGGC
AGCGAGGTGAACATCGTGACCGACAGCCAGTACGCCCTGGGCATCATCCAGGCCCAGCCCGACAAGAGCGAGAGC
GAGCTGGTGAACCAGATCATCGAGCAGCTGATCAAGAAGGAGAAGGTGTACCTGAGCTGGGTGCCCGCCCACAAG
GGCATCGGCGGCAACGAGCAGATCGACAAGCTGGTGAGCAAGGGCATCCGCAAGGTGCTCTAA
```

TatRevNef.ProtRT.opt_C

```
GCCACCATGGAGCCCGTGGACCCCAACCTGGAGCCCTGGAACCACCCCGGCAGCCAGCCCAAGACCGCC
GGCAACAAGTGCTACTGCAAGCACTGCAGCTACCACTGCCTGGTGAGCTTCCAGACCAAGGGCCTGGGC
ATCAGCTACGGCCGCAAGAAGCGCCGCCAGCGCCGCAGCGCCCCCCCCAGCAGCGAGGACCACCAGAAC
CCCATCAGCAAGCAGCCCCTGCCCCAGACCCGCGGCGACCCCACCGGCAGCGAGGAGAGCAAGAAGAAG
GTGGAGAGCAAGACCGAGACCGACCCCTTCGACCCCGGGGCCGGCCGCAGCGGCGACAGCGACGAGGCC
CTGCTGCAGGCCGTGCGCATCATCAAGATCCTGTACCAGAGCAACCCCTACCCCAAGCCCGAGGGCACC
CGCCAGGCCGACCTGAACCGCCGCCGCCGCTGGCGCGCCCGCCAGCGCCAGATCCACAGCATCAGCGAG
CGCATCCTGAGCACCTGCCTGGGCCGCCCCGCCGAGCCCGTGCCCTTCCAGCTGCCCCCCGACCTGCGC
CTGCACATCGACTGCAGCGAGAGCAGCGGCACCAGCGGCACCCAGCAGAGCCAGGGCACCACCGAGGGC
GTGGGCAGCCCCCTCGAGGCCGGCAAGTGGAGCAAGAGCAGCATCGTGGGCTGGCCCGCCGTGCGCGAG
CGCATCCGCCGCACCGAGCCCGCCGCCGAGGGCGTGGGCGCCGCCAGCCAGGACCTGGACAAGCACGGC
GCCCTGACCAGCAGCAACACCGCCGCCAACAACGCCGACTGCGCCTGGCTGGAGGCCCAGGAGGAGGAG
GAGGAGGTGGGCTTCCCCGTGCGCCCCAGGTGCCCCTGCGCCCCATGACCTACAAGGCCGCCTTCGAC
CTGAGCTTCTTCCTGAAGGAGAAGGGCGGCCTGGAGGGCCTGATCTACAGCAAGAAGCGCCAGGAGATC
CTGGACCTGTGGGTGTACCACACCCAGGGCTTCTTCCCCGGCTGGCAGAACTACACCCCCGGCCCCGGC
GTGCGCTACCCCCTGACCTTCGGCTGGTGCTTCAAGCTGGTGCCCGTGGACCCCCGCGAGGTGGAGGAG
GCCAACAAGGGCGAGAACAACTGCCTGCTGCACCCCATGAGCCAGCACGGCATGGAGGACGAGGACCGC
GAGGTGCTGAAGTGGAAGTTCGACAGCAGCCTGGCCCGCCGCCACATGGCCCGCGAGCTGCACCCCGAG
TACTACAAGGACTGCGAATTCCCCCAGATCACCCTGTGGCAGCGCCCCCTGGTGAGCATCAAGGTGGGC
GGCCAGATCAAGGAGGCCCTGCTGGACACCGGCGCCGACGACACCGTGCTGGAGGAGATGAGCCTGCCC
GGCAAGTGGAAGCCCAAGATGATCGGCGGCATCGGCGGCTTCATCAAGGTGCGCCAGTACGACCAGATC
CTGATCGAGATCTGCGGCAAGAAGGCCATCGGCACCGTGCTGATCGGCCCCACCCCCGTGAACATCATC
GGCCGCAACATGCTGACCCAGCTGGGCTGCACCCTGAACTTCCCCATCAGCCCCATCGAGACCGTGCCC
GTGAAGCTGAAGCCCGGCATGGACGGCCCCAAGGTGAAGCAGTGGCCCCTGACCGAGGAGAAGATCAAG
GCCCTGACCGCCATCTGCGAGGAGATGGAGAAGGAGGGCAAGATCACCAAGATCGGCCCCGAGAACCCC
TACAACACCCCCGTGTTCGCCATCAAGAAGAAGGACAGCACCAAGTGGCGCAAGCTGGTGGACTTCCGC
GAGCTGAACAAGCGCACCCAGGACTTCTGGGAGGTGCAGCTGGGCATCCCCACCCCGCCGGCCTGAAG
AAGAAGAAGAGCGTGACCGTGCTGGACGTGGGCGACGCCTACTTCAGCGTGCCCCTGGACGAGGACTTC
CGCAAGTACACCGCCTTCACCATCCCCAGCATCAACAACGAGACCCCCGGCATCCGCTACCAGTACAAC
GTGCTGCCCCAGGGCTGGAAGGGCAGCCCCAGCATCTTCCAGAGCAGCATGACCAAGATCCTGGAGCCC
TTCCGCGCCCGCAACCCCGAGATCGTGATCTACCAGGCCCCCCTGTACGTGGGCAGCGACCTGGAGATC
GGCCAGCACCGCGCCAAGATCGAGGAGCTGCGCAAGCACCTGCTGCGCTGGGGCTTCACCACCCCCGAC
AAGAAGCACCAGAAGGAGCCCCCCTTCCTGCCCATCGAGCTGCACCCCGACAAGTGGACCGTGCAGCCC
ATCGAGCTGCCCGAGAAGGAGAGCTGGACCGTGAACGACATCCAGAAGCTGGTGGGCAAGCTGAACTGG
GCCAGCCAGATCTACCCCGGCATCAAGGTGCGCCAGCTGTGCAAGCTGCTGCGCGGCGCCAAGGCCCTG
ACCGACATCGTGCCCCTGACCGAGGAGGCCGAGCTGGAGCTGGCCGAGAACCGCGAGATCCTGCGCGAG
CCCGTGCACGGCGTGTACTACGACCCCAGCAAGGACCTGGTGGCCGAGATCCAGAAGCAGGGCCACGAC
CAGTGGACCTACCAGATCTACCAGGAGCCCTTCAAGAACCTGAAGACCGGCAAGTACGCCAAGATGCGC
ACCGCCCACACCAACGACGTGAAGCAGCTGACCGAGGCCGTGCAGAAGATCGCCATGGAGAGCATCGTG
ATCTGGGGCAAGACCCCCAAGTTCCGCCTGCCCATCCAGAAGGAGACCTGGGAGACCTGGTGGACCGAC
TACTGGCAGGCCACCTGGATCCCCGAGTGGGAGTTCGTGAACACCCCCCCCTGGTGAAGCTGTGGTAC
CAGCTGGAGAAGGAGCCCATCATCGGCGCCGAGACCTTCTACGTGGACGGCGCCGCCAACCGCGAGACC
AAGATCGGCAAGGCCGGCTACGTGACCGACCGGGCCGGCAGAAGATCGTGAGCCTGACCGAGACCACC
AACCAGAAGACCGAGCTGCAGGCCATCCAGCTGGCCCTGCAGGACAGCGGCAGCGAGGTGAACATCGTG
ACCGACAGCCAGTACGCCCTGGGCATCATCCAGGCCCAGCCCGACAAGAGCGAGAGCGAGCTGGTGAAC
CAGATCATCGAGCAGCTGATCAAGAAGGAGAAGGTGTACCTGAGCTGGGTGCCCGCCCACAAGGGCATC
GGCGGCAACGAGCAGATCGACAAGCTGGTGAGCAAGGGCATCCGCAAGGTGCTCTAA
```

FIGURE 58 (SEQ ID NO:61)

```
atgagagtgatggggacacagaagaattgtcaacaatggtggatatggggcatcttaggc
ttctggatgctaatgatttgtaacacggaggacttgtgggtcacagtctactatggggta
cctgtgtggagagacgcaaaaactactctattctgtgcatcagatgctaaagcatatgag
acagaagtgcataatgtctgggctacacatgcctgtgtacccacagaccccaacccacaa
gaaatagtttgggaaatgtaacagaaaattttaatatgtggaaaaatgacatggcagat
cagatgcatgaggatgtaatcagtttatgggatcaaagcctaaagccatgtgtaaagttg
acccactctgtgtcactttaaactgtacagatacaaatgttacaggtaatagaactgtt
acaggtaatagtaccaataatacaaatggtacaggtatttataacattgaagaaatgaaa
aattgctctttcaatgcaaccacagaattaagagataagaaacataaagagtatgcactc
ttttatagacttgatatagtaccacttaatgagaatagtgacaactttacatatagatta
ataaattgcaatacctcaaccataacacaagcctgtccaaaggtctcttttgacccgatt
cctatacattactgtgctccagctggttatgcgattctaaagtgtaataataagacattc
aatgggacaggaccatgttataatgtcagcacagtacaatgtacacatggaattaagcca
gtggtatcaactcaattactgttaaatggtagtctagcagaagaagggataataattaga
tctgaaaatttgacagagaataccaaaacaataatagtacaccttaatgaatctgtagag
attaattgtacaagacccaacaataatacaagaaaaagtgtaaggataggaccaggacaa
gcattctatgcaacaaatgatgtaataggaaacataagacaagcacattgtaacattagt
acagatagatggaacaaaactttacaacaggtaatgaaaaaattaggagagcatttccct
aataaaacaatacaatttaaaccacatgcaggaggggatctagaaattacaatgcatagc
tttaattgtagaggagaattttctattgtaatacatcaaacctgtttaatagcacatac
cactctaataatggtacatacaaatacaatggtaattcaagctcacccatcacactccaa
tgtaaaataaaacaaattgtacgcatgtggcaaggggtaggacaagcaacgtatgccct
cccattgcaggaaacataacatgtagatcaaacatcacaggaatactattgacacgtgat
ggaggatttaacaccacaaacaacacagagacattcagacctggaggaggagatatgagg
gataactggagaagtgaattatataatataaagtagtagaaattaagccattgggaata
gcacccactaaggcaaaaagaagagtggtgcagagagaaaaaagagcagtgggaatagga
gctgtgttccttgggttcttgggagcagcaggaagcactatgggcgcagcgtcaataacg
ctgacggtacaggccagacaactgttgtctggtatagtgcaacagcaaagcaatttgctg
aaggctatagaggcgcaacagcatatgttgcaactcacagtctggggcattaagcagctc
caggcgagagtcctggctatagaaagatacctaaaggatcaacagctcctagggatttgg
ggctgctctggaagactcatctgcaccactgctgtgccttggaactccagttggagtaat
aaatctgaaaagatatttgggataacatgacttggatgcagtgggatagagaaattagt
aattacacaggcttaatatacaatttgcttgaagactcgcaaaaccagcaggaaaagaat
gaaaagatttattagaattggacaagtggaacaatctgtggaattggtttgacatatca
aactggccgtggtatataaaaatattcataatgatagtaggaggcttgataggtttaaga
ataatttttgctgtgctttctatagtgaatagagttaggcagggatactcacctttgtca
tttcagacccttaccccaagcccgaggggactcgacaggctcggaggaatcgaagaagaa
ggtggagagcaagacagagacagatccatacgattggtgagcggattcttgtcgcttgcc
tgggacgatctgcggaacctgtgcctcttcagctaccaccgcttgagagacttcatatta
attgcagtgagggcagtggaacttctgggacacagcagtctcaggggactacagaggggg
tgggaaatccttaagtatctgggaagtcttgtgcaatattggggtctagagctaaaaaag
agtgctattagtctgcttgataccatagcaataacagtagctgaaggaacagataggatt
atagaattagtacaaagaatttgtagagctatcctcaacatacctagaagaataagacag
ggctttgaagcagctttgctataa
```

FIGURE 59 (SEQ ID NO:62)

```
atgagagtgatggggacacagaagaattgtcaacaatggtggatatggggcatcttaggc
ttctggatgctaatgatttgtaacacggaggacttgtgggtcacagtctactatggggta
cctgtgtggagagaagcaaaaactactctattctgtgcatcagatgctaaagcatatgag
acagaagtgcataatgtctgggctacacatgcttgtgtacccacagaccccaacccacaa
gaaatagttttgggaaatgtaacagaaatttttaatatgtggaaaaataacatggcagat
cagatgcatgaggatataatcagtttatgggatcaaagcctaaagccatgtgtaaagttg
accccactctgtgtcactttaaactgtacagatacaaatgttacaggtaatagaactgtt
acaggtaatacaaatgataccaatattgcaaatgctacatataagtatgaagaaatgaaa
aattgctctttcaatgcaaccacagaattaagagataagaaacataaagagtatgcactc
ttttataaacttgatatagtaccacttaatgaaaatagtaacaactttacatatagatta
ataaattgcaatacctcaaccataacacaagcctgtccaaaggtctcttttgacccgatt
cctatacattactgtgctccagctgattatgcgattctaaagtgtaataataagacattc
aatgggacaggaccatgttataatgtcagcacagtacaatgtacacatggaattaagcca
gtggtatcaactcaactactgttaaatggtagtctagcagaagaagggataataattaga
tctgaaaatttgacagagaataccaaaacaataatagtacatcttaatgaatctgtagag
attaattgtacaaggcccaacaataatacaaggaaaagtgtaaggataggaccaggacaa
gcattctatgcaacaaatgacgtaataggaaacataagacaagcacattgtaacattagt
acagatagatggaataaaactttacaacaggtaatgaaaaaattaggagagcatttccct
aataaaacaataaatttgaaccacatgcaggaggggatctagaaattacaatgcatagc
tttaattgtagaggagaattttctattgcaatacatcaaacctgtttaatagtacatac
taccctaagaatggtacatacaaatacaatggtaattcaagcttacccatcacactccaa
tgcaaaataaaacaaattgtacgcatgtggcaaggggtaggacaagcaatgtatgcccct
cccattgcaggaaacataacatgtagatcaaacatcacaggaatactattgacacgtgat
gggggatttaacaacacaaacaacgacacagaggagacattcagacctggaggaggagat
atgagggataactggagaagtgaattatataaatataaagtggtagaaattaagccattg
ggaatagcacccactaaggcaaaaagaagagtggtgcagagaaaaaaaagagcagtggga
ataggagctgtgttccttgggttcttgggagcagcaggaagcactatgggcgcagcgtca
ataacgctgacggtacaggccagacaactgttgtctggtatagtgcaacagcaaagcaat
ttgctgaaggctatagaggcgcaacagcatatgttgcaactcacagtctggggcattaag
cagctccaggcgagagtcctggctatagaaagatacctaaaggatcaacagctcctaggg
atttggggctgctctggaagactcatctgcaccactgctgtgccttggaactccagttgg
agtaataaatctgaagcagatatttgggataacatgacttggatgcagtgggatagagaa
attaataattacacagaaacaatattcaggttgcttgaagactcgcaaaaccagcaggaa
aagaatgaaaaagatttattagaattggacaagtggaataatctgtggaattggtttgac
atatcaaactggctgtggtatataaaaatattcataatgatagtaggaggcttgataggt
ttaagaataatttttgctgtgctctctatagtgaatagagttaggcagggatactcacct
ttgtcatttcagacccttaccccaagcccgaggggactcgacaggctcggaggaatcgaa
gaagaaggtggagagcaagacagagacagatccatacgattggtgagcggattcttgtcg
cttgcctgggacgatctgcggagcctgtgcctcttcagctaccaccgcttgagagacttc
atattaattgcagtgagggcagtggaacttctgggacacagcagtctcaggggactacag
aggggtgggagatccttaagtatctgggaagtcttgtgcagtattggggtctagagcta
aaaaagagtgctattagtccgcttgataccatagcaatagcagtagctgaaggaacagat
aggattatagaattggtacaaagaatttgtagagctatcctcaacatacctaggagaata
agacagggctttgaagcagctttgctataa
```

FIGURE 60 (SEQ ID NO:63)

```
atgagagcgaggggggatactgaagaattatcgacactggtggatatggggcatcttaggc
ttttggatgctaatgatgtgtaatgtgaagggcttgtgggtcacagtctactacggggta
cctgtggggagagaagcaaaaactactctatttgtgcatcagatgctaaagcatatgag
aaagaagtgcataatgtctgggctacacatgcctgtgtacccacagaccccaacccacaa
gaagtgattttgggcaatgtaacagaaaattttaacatgtggaaaaatgacatggtggat
cagatgcaggaagatataatcagtttatgggatcaaagccttaagccatgtgtaaaattg
accccactctgtgtcactttaaactgtacaaatgcaactgttaactacaataatacctct
aaagacatgaaaaattgctctttctatgtaaccacagaattaagagataagaaaaagaaa
gaaaatgcacttttttatagacttgatatagtaccacttaataataggaagaatgggaat
attaacaactatagattaataaattgtaatacctcagccataacacaagcctgtccaaaa
gtctcgtttgacccaattcctatacattattgtgctccagctggttatgcgcctctaaaa
tgtaataataagaaattcaatggaataggaccatgcgataatgtcagcacagtacaatgt
acacatggaattaagccagtggtatcaactcaattactgttaaatggtagcctagcagaa
gaagagataataattagatctgaaaatctgacaaacaatgtcaaaacaataatagtacat
cttaatgaatctatagagattaaatgtacaagacctggcaataatacaagaagagtgtg
agaataggaccaggacaagcattctatgcaacaggagacataataggagatataagacaa
gcacattgtaacattagtaaaaatgaatggaatacaactttacaaagggtaagtcaaaaa
ttacaagaactcttccctaatagtacagggataaaatttgcaccacactcaggaggggac
ctagaaattactacacatagctttaattgtggaggagaattttctattgcaatacaaca
gacctgtttaatagtacatacagtaatggtacatgcactaatggtacatgcatgtctaat
aatacagagcgcatcacactccaatgcagaataaaacaaattataaacatgtggcaggag
gtaggacgagcaatgtatgcccctcccattgcaggaaacataacatgtagatcaaatatt
acaggactactattaacacgtgatggaggagataataatactgaaacagagacattcaga
cctggaggaggagacatgagggacaattggagaagtgaattatataaatacaaggtggta
gaaattaaaccattaggagtagcacccactgctgcaaaaggagagtggtggagagagaa
aaaagagcagtaggaataggagctgtgttccttgggttcttgggagcagcaggaagcact
atgggcgcagcatcaataacgctgacggtacaggccagacaattattgtctggtatagtg
caacagcaaagtaatttgctgagggctatagaggcgcaacagcatatgttgcaactcacg
gtctggggcattaagcagctccaggcaagagtcctggctatagagagatacctacaggat
caacagctcctaggactgtggggctgctctggaaaactcatctgcaccactaatgtgctt
tggaactctagttggagtaataaaactcaaagtgatatttgggataacatgacctggatg
cagtgggatagggaaattagtaattacacaaacacaatatacaggttgcttgaagactcg
caaagccagcaggaaagaaatgaaaagatttactagcattggacaggtggaacaatctg
tggaattggtttagcataacaaattggctgtggtatataaaaatattcataatgatagta
ggaggcttgataggtttaagaataatttttgctgtgctctctctagtaaatagagttagg
cagggatactcaccttgtcattgcagacccttatcccaaacccgaggggacccgacagg
ctcggaggaatcgaagaagaaggtggagagcaagacagcagcagatccattcgattagtg
agcggattcttgacacttgcctgggacgacctacgaagcctgtgcctcttctgctaccac
cgattgagagacttcatattaattgtagtgagagcagtggaacttctgggacacagtagt
ctcaggggactgcagagggggtggggaacccttaagtatttggggagtcttgtgcaatat
tggggtctagagttaaaaaagagtgctattaatctgcttgatactatagcaatagcagta
gctgaaggaacagataggattctagaattcatacaaaaacctttgtagaggtatccgcaac
gtacctagaagaataagacagggcttcgaagcagctttgcaataa
```

FIGURE 61 (SEQ ID NO:64)

atgagagtgaggggggatactgaggaattggcaacaatggtggatatggggcatcttaggc
ttttggatgttaatgatttatagtgtattggggaacttgtgggtcacagtctattatggg
gtacctgtgtggaagaagcaaaaactactctattctgtgcatcagatgctaaagcatat
gagagagaagtgcataatgtctgggctacacatgcctgtgtgcccacagaccccaacccg
caagaaatggtcttgggaaatgtaacagaaattttaacatgtggaaaaatgatatggtg
gatcagatgcatgaggatataatcagtttatgggatcaaagcctaaagccatgtgtaaag
ttgacccactctgtgtcactttagagtgtaataacgttaatactaccaatgaaatgaca
aattgctctttcaatgcaaccacagacgtaagagataagaaacagagagtgtctgcattt
ttttatagacttgatatagtaccacttaatgagaataacaatgaatcccagaagtataga
ttaataagttgcaatacctcaaccataacacaagcctgtccaaaggtcacttttgaccca
attcctatacattactgtactccagctggttatgcgattctaaagtgtaataataagaca
ttcaatgggacaggaccatgccataatgtcagcacagtacaatgtacacatggaattaag
ccagtagtatcaactcaactactattgaatggtagcctagcagaagaagagataatcatt
agatctgaaaatctgacaaacaatgccaaaataataatagtacaccttaatgaatctgta
gaaattgtgtgtacaagacccaacaataatacaagaaaaagtataaggataggaccggga
caaacattctatgcaacaaatggcataataggaaacataagacaagcacattgtaacatt
agtgaagagagatggaacaaaaccttacaacaggtaggaaaaaaattagcagaacacttc
cctaataaaacaataaagtttgaaccatcctcaggaggggatctagaaattactacacat
agctttaattgtggaggagaattttttctattgcaatacatcaggcctgtttaatggtaca
tacaatcacactacagaaggtaattcaaactcaaccatcacactcccatgcagaataaaa
caaattataaacatgtggcgggaggtaggacgagcaatgtatgctcctcccattgcagga
aacataacatgtaaatcaaatatcacaggattactattagtgcgtgatggaggagaaagc
aatgactcagacaacaacatcgagatattcagacctggaggaggagatatgaggaacaat
cggagaagtgaattatataaatataaagtggtagaaattaagccattgggaatagcaccc
actggggcaaaaaggagagtggtggagagagaaaaaagagcagtgggactaggagctatg
ttccttgggttcttgggagcagcaggaagcactatgggcgcggcgtcaataacgctgacg
gtacaggccagacaactgttgtctggtatagtgcaacagcaaagcaatttgctgaaggct
atagaggcgcaacagcatatgttgcaactcacggtctggggcattaagcagctccagaca
agagtcctggctatagaaagatacctaaaggatcaacagctcctagggctttgggctgc
tctggaaaactcatctgcaccactgctgtgccttggaactccagttggagtaataaatct
gtaacagatatttgggataacatgacctggatgcagtgggataggaaattagtaattac
acaaacacaatatacaggttgcttgaagactcgcaaacccagcaggaacaaaatgaaaaa
gatttattagcactggacagttggaataatttgtggaattggtttaacataacaaagtgg
ctgtggtacataaaaatattcataatgatggtaggaggcttgataggcttaagaataatt
tttgctgtgctctctgtagtaaatagagttaggcaggggtattcaccattatcgtttcag
acccttatcccaagcccgaggggacccgacaggctcggaagaatcgaagaagaaggtgga
gagcaagacagagacagatccgtgcgattagtgaacggattcttagccattgcctgggac
gatctacggagcctgtgtcttttcagctaccaccgattgagagacttcatattgattgca
acgagagcggtggaacttctgggacgcagcagtctcaggggattgcagagggggtgggaa
gcccttaagtatctaggaagtcttgtgcagtattggggtctggaactaaaaaagagtgct
gttagtctgcttgataccgtagcaatagtagtagctgaaggaacagataggattatagaa
ttagtacaaagagtttgcagagctatccgcaacatacctacaagaatcagacagggcttt
gaaacagctttgctataa

FIGURE 62 (SEQ ID NO:65)

```
atgagagtgagggagataccgaggaattggcaacaatggtggatatggggaatcttaggc
ttttggatggtaatgatttgtaatgtgatggggaacttgtgggtcacagtctattatggg
gtacctgtgtggaaagaagcaaaaactactctattctgtgcatcagatgctaaagcatat
gagaacgaagtgcataatgtctgggctacacatgcctgtgtacccacagaccccaaccca
caagaaatagttttggaaaatgtaacagaaaattttaacatgtggaaaaatgacatggtg
gatcagatgcatgaggatataatcagtttatgggatcaaagcctacagccatgtgtaaag
ttgacccactctgtgtcactttaaattgtacaacggttaccaacagtaccgtcaataac
acgcgtggagagatgcgaaattgctctttcaatatgaccacagaagtaagagataagaaa
cagcaagtgtatgcactttttataaacttgatgtagtaccacttaatgaaaataatagt
gactctagcaactttagtgagtatagattaataaattgtaatacctcagccatgacacaa
gcctgtccaaaggtcacttttgacccaattcctatacattattgtgctccagctggttat
gcgattctaaagtgtaataataagacatttaatgggacaggaccatgcagtaatgtcagc
acagtacaatgtacacatggaattaagccagtggtatcaactcaactcctgttaaatggt
agcctagcagaaaagaaataataattagatccgaaatctgacaaacaatgtcaaaaca
ataatagtacatcttaatgaatccatagaaattaggtgtacaagacccaacaataataca
agaaaaagtataaggataggaccaggacaaacattctatgcaacaggagaaataatagga
gacataagacaagcacactgtaccattagtagtcagaactggaatagaactttacaaagg
gtaagtgaaaaattaaaagaacacttccctaataaaacaataaaatttgaaccatcctca
ggaggggacctagaaataacaacacatagctttaattgtagaggagaatttttttattgc
aatacatcaggcctatttaatagaacatttaatagtacatacatgcataatagtacaaac
aatgactcaatcatcacaatcccatgcagaataaaacaaattataaacatgtggcaggag
gtaggaagagcaatgtatgcccctcccgttgcaggaaacataacatgtaaatcaaatatc
acaggactactattggtacgggatggaggcgaaaatggcacaaataacacagaggtattc
agacctggaggaggaaatatgagggacaattggagaagtgagttatataaatataaagtg
gtagaaattaaaccattgggagtagcacccaataaggcaaaaaggagagtggtggagaga
gaaaaaagagcagtgggaataggagctgtgttccttgggttcttgggagcagcaggaagc
actatgggcgcggcgtcaatagcgctgacggcacaagccagacaagtattgtctggtata
gtgcaacagcaaagcaatttgctgaaggctatagaggcgcagcagcatctgttgcaactc
acagtctggggcattaagcagctccagacaagagtcctggctatagaaagatacctaaag
gatcaacagctcctagggatttgggctgctctggaaaaatcatctgccccactgctgtg
ccttggaactccagttggagtaataaatctcaagaagatatttggggaaacatgacctgg
atgcagtgggatagagaaattagtagttacacaaacacaatatacaatttgcttgaagaa
tcgcaaagacagcaggagaaaaatgaaaaggatttattagaattggacagttggaacttt
ttgtggagttggtttgacataacaaagtggctgtggtatataaaaatattcataataata
gtaggaggcttgataggtttaagaataatttttgctgtgctctctatagtgaatagagtt
aggcagggatactcacctttgtcgttccagacccttaccccgagcccaggggggacccgac
aggctcggaagaatcgaagaagaaggtggagagcaagacagagacagatccgtgagatta
gtgaacggattcttagcacttgcctgggacgacctgcggagcctgtgcctttcagctac
caccgattgagagacttcatattggtgacagcgagagcggtggaacttctgggacgcagc
agtctcaggggactacagagggggtgggaagctcttaagtatctgggaagccttgtgcaa
tattggggtctggagctaaaaagagtgctactagcctgcttgataccatagcaataaca
gtagctgaaggaacagataggattatagaaatagtacaaagattctgtagagctatcctc
catatacctagaagaataagacagggctttgaagcagctttgctataa
```

FIGURE 63 (SEQ ID NO:66)

```
gtcgacaagagcagaagacagtggcaatgagagtgacggggatactgaggaattacccac
aatggtggatatgggtcatcttaggcttttagataatatataatgtgggagggatgtggg
tcacagtctattatggggtacctgtgtggaaggaggcaaaaactactctattttgtgcat
cagatgctaaagcatatgataaagaagtgcataatgtctgggccacacatgcctgtgtac
ccacagatcccaacccacaagaattggttttggaaaatgtaacagaaaattttaatatgt
ggaaaaatgacatggtggatcagatgcatgaagacataatcagtttatgggatgaaagcc
taaaaccatgtgtaaagttgacccactctgtgtcactttaaattgtaaggcaaatgtta
ctgttaatactacgaactttaatgatagcatgattgaacaaatgagaaattgctctttca
atataaccacagaactaagagataagaaaaagcaagtgtatgcactttttttataagcttg
atataatacaacttgataatgacaactctagtgacaactctggttatagattaataaatt
gtaatacctcagccataacacaagcctgtccaaaggtcacttttgacccaattcctatac
attattgtgctccagctggatatgcgattctaaagtgtaataataagacattcaatggaa
caggaccatgcagtaatgttagcacagtacaatgtacacatggaattaagccagtggtat
caactcaactactgttaaatggtagcctagcagaaggagatataataattagatctcaaa
acctgacaaacaatgccaaaataataatagtacatcttaatgaatctgtagaaattgtgt
gtacaagacccggcaataatacaagacaaagtataaggataggaccaggacaaacattct
atgcaacaggagacataataggagacataaggcaagcacattgtaacattagtgcaggga
aatggaatgaaactttaaaaagggtaagtaaaaaattaggagaacactttcctaataaaa
caataaatttgcaccacactcaggaggggacctagaaattacaatgcatagttttaatt
gtagaggagaatttttttattgtaatacatcaagtctgtttaatagtagttataatacat
cagacctgtttaatagtaataatggttcagccatcacactcccatgcagaataaaacaaa
ttgtaaacatgtggcaggggtaggacgagcaatatatgcccctcccattgcaggaaaca
taacatgtaactcaagtatcacaggactactcttggtacgtgatggaggaaacacaacca
actcaactgagatattcagaccagaaggaggaaatatgagggacaattggagaagtgaat
catataaatacaaagtggtagaaattaagcccttgggaatagcgcccactaatgcaaaaa
ggagagtggtggagagagaaaaaagagcagtgacactaggagctatgttccttgggttct
tgggagcagcaggaagcactatgggcgcagcgtcaataacgctgacggcacaggccagac
agttgttgtctggaatagtgcaacagcaaagcaatttgctgagagctatagagacgcaac
agcatatgttgcaactcacagtttggggcattaaacagctccaagcaagagtcttggcta
tagaaagatacctaaaggatcaacagctcctaggaatttggggctgctctggaaaactca
tctgcaccactgctgtgccttggaactccagttggagtaataaaactgagaaagatattt
gggaaaacatgacctggatgcagtgggatagagaaattagtaattacacagacataatat
acaacttacttgaagtctcgcaaatccagcaggaacagaataaaaaagatttattagcat
tggacagttggaaaattctgtggagttggtttgacatatcaagttggctgtggtacataa
gaatattcataatgatagtaggaggcttgataggcttgagaataatttctgctgtgcttt
ctatagtgaatagagttaggcagggatactcacctttgtcgtttcagacccttgccccga
acccaagggaactcgacaggctcggaagaatcgaagaagaaggtggagagcaagacagag
acagatcgattcgattagtacaaggattcttagcacttgcctgggacgacttgaggagcc
tgtgccttttcagctaccaccgattgagagacttcatattgattgcagcgaaagcagcgg
aacttctgggacacaacagtctcaggggactacagaggggtgggaaatccttaagtatc
tgggaagtcttgctcaatattggggtctagaactcaaaaagagtgctattagtttgcttg
ataccatagcaatagcagtagctgaaggaacagataggattatagaattaatacaaagaa
tttggagagctatccgcaacacacctagaagaataagacagggctttgaagcagctttgc
aataactctagaaagaaacaagggcgaattc
```

FIGURE 64 (SEQ ID NO:67)

```
gtcgacaagagcagaagacagtggcaatgagagtgaggggatactgaggaattatccac
aatggtggatatgggtcatcttaggctttggataatatataatgtgggagggaacatgt
gggtcacagtctattatggggtacctgtgtggaaagatgcaaaaactactctattttgtg
catcagatgctaaagcatatgataaagaagtgcataatgtctgggccacacatgcctgtg
tacccacagatcccaacccacaagaattagttttggaaaatgtaacagaaaattttaaca
tgtggaaaaatgacatggtggatcagatgcatgaagacataatcagtttatgggatgaaa
gcctaaaaccatgtgtaaagttgacccactctgtgtcactttaaattgtacagataatg
ttactgttaatactacgagccttactgttagccctactgttaacataactgaacaaataa
gaaattgctctttcaatataaccacagaactaagggataagaaaaagcaagtgtatgcac
tttttataggcttgacatagtacaatttgataatgacaactctagttataggttaataa
attgtaatacctcagccataacacaagcctgtccaaaggtcacttttgacccaattccta
tacattattgtgctccagctggatatgcgattctaaagtgtaataataagacattcaatg
gaacaggaccatgcagtaatgtcagcacagtacaatgtacacatggaattaagccagtgg
tatcaactcaactactgttaaatggtagcctagcagaaggagatataataattagatctc
aaaacctgacaaacaatgccaaaataataatagtacatcttaatgaatctgtagaaattg
tgtgtacaagacccggcaataatacaagacaaagtataaggataggaccaggacaaacat
tctatgcaacaggagacataataggagacataaggcaagcacattgtaacattagtgcag
ggaaatggaatgaaactttaaaaagggtaagtaaaaaattaggagaacacttcctaata
aaacaataaaatttgcaccacactcaggagggacctagaaattacaatgcatagtttta
attgtagaggagaatttttttattgtaatacatcaagtctgtttaatagtagttataata
catcaggcctgtttaatagtaataatggttcaaccatcacactcccatgcagaataaaac
aaattgtaaacatgtggcagggggtaggacgagcaatatatgcccctcccattgcaggaa
acataacatgtaactcaagtatcacaggactactcttggtacgtgatggaggaaacacaa
ccaactcaaccgagacattcagaccagaaggaggaaatatgagggacaattggagaagtg
aattatataaatataaagtggtagaaattaagcccttgggaatagcgcccactaatgcaa
aaaggagagtggtggagagagaaaaaagagcagtgacactaggagctatgttccttgggt
tcttgggagcagcaggaagcactatgggcgcagcgtcaatagcgctgacggcacaggcca
gacggttgttgtctggaatagtgcaacagcaaagtaatttgctgaaagctatagaggcgc
aacagcatatgttgcaactcacagtttggggcattaaacagctccaagcaagagtcttgg
ctatagaaagatacctaaaggatcaacagctcctaggaatttggggctgctctggaaaac
tcatctgcaccactgctgtgccttggaactccagttggagtgataaaactgagaaagata
tttgggaaaacatgacctggatgcagtgggatagagaaattagtaattacacagacataa
tatacaatttacttgaagtctcgcaaatccagcaggaacagaatgaaaaagatttattgg
cattggacagttggaaaagtctgtggaattggtttgacatatcaaaatggctgtggtaca
taaaaatattcataatgatagtaggaggcttgataggcttgagaataattttgctgtgc
tttctatagtgaatagagttaggcagggatactcacctttgtcatttcagacccttatcc
cgaacccaagggaactcgacaggctcggaagaatcgaagaagaagtggagagcaagaca
gagacagatcgattcgattagtacaaggattcttagcacttgcctgggacgacttgagga
gcctgtgccttttcagctaccaccgattgagaaacttcatattgattgctgcaagagcag
cggaacttctgggacacagcagtctcagggactacagagggggtgggaaatccttaagt
atctgggaagtcttgcacaatattggggtctagaactcaaaaggagtgctattagtctgc
ttgacatcacagcaattgcagtagctgaaggaacagataggattatagaattaatacaaa
gaatttggagagctatccgcaacatacctacaaggataagacagggctttgaagcagctt
tgcaataactctagaaagaaacaagggcgaattc
```

FIGURE 65 (SEQ ID NO:68)

```
atgagagtgacggggatactgaggaattatccacaatggtggatatgggtcatcttaggc
ttttggataatatataatgtgggagggaacatgtgggtcacagtctattatggggtacct
gtgtggaaagaggcaaaaactactctattttgtgcatcagatgctaaagcatatgataaa
gaagtgcataatgtctgggccacacatgcctgtgtacccacagatcccaacccacaagat
ttggttttggaaaatgtaacagaaaattttaatatgtggaaaaatgacatggtggatcag
atgcatgaagacataatcagtttatgggatgaaagcctaaaaccatgtgtaaagttgacc
ccactctgtgtcactttaaattgtaaagcaaatgttactgttaaaactaatgcaaatgtt
actgttaatactacgaactttaatgatagcatgattgaacaaatgaggaattgctctttc
aatataaccacagaactaagagataagaaaaagcaagtgtatgcactttttataggctt
gatatagtacaatttgacaatgacaactctagttataggttaataaattgtaatacctca
gccataacacaagcctgtccaaaggtcacttttgacccaattcctatacattattgtgct
ccagctggatatgcgattctaaagtgtaataataagacattcaatggaacaggaccatgc
agtaatgttggcacagtacaatgtacacatggaattaagccagtggtatcaactcaacta
ctgttaaatggtagcctagcagaaggagatataataattagatctcaaaacctgacaaac
aatgccaaaataataatagtacatcttaatgaatctgtagaaattgtgtgtacaagaccc
ggcaataatacaagacaaagtataaggataggaccaggacaaacattctatgcaacagga
gacataataggagacataaggcaagcacattgtaacattagtgcagggaaatggaatgaa
actttaaaaagggtaagtaaaaaattaggagaacactttcctaataaaacaataaaattt
gcaccacactcaggaggggacctagaaattacaatgcatagttttaattgtagaggagaa
ttttttattgtaatacatcaagtctgtttaatagtagttataatacatcaggcctgttt
aatagtaataatggttcaaccatcacactcccatgcagaataaaacaaattgtaaacatg
tggcagggggtaggacgagcaatatatgcccctcccattgcaggaaacataacatgtaac
tcaagtatcacaggactactcttggtacgtgatggaggaaacataaccaactcaaccgag
atattcagaccagaaggaggaaatatgagggacaattggagaagtgaattatataaatat
aaagtggtagaaattaagccattgggaatagcgcccactaatgcaaaaaggagagtggtg
gagagagaaaaaagagcagtgacactaggagctatgttccttgggttcttgggagcagca
ggaagcactatgggcgcagcgtcaataacgctgacggcacaggccagacagttgttgtct
ggaatagtgcaacagcaaagcaatttggtgagagctatagaggcgcaacagcatatgctg
caactcacagtctggggcattaagcagctccaagcaagagtcttggctatagaaagatac
ctaaaggatcagcagctcctaggaatttggggctgctctggaaaactcatctgcaccact
gctgtgccttggaactccagttggagtagtaaaactgagaaagatatttgggaaaatatg
acctggatgcagtgggatagagaaattagtaattacacagacataatatacaacctactt
gaagtctcgcaaatccagcaggaacagaatgaaaaagatttattagcattggacagttgg
aaaaatctgtggaattggtttgacatatcaaaatggctgtggtacataaaaatattcata
atgatagtaggaggcttgataggcttgaggataattttgctgtgctttctatagtgaat
agagttaggcagggatactcacctttgtcgtttcagacccttatcccgaacccaagggaa
ctcgacaggctcggaagaatcgaagaagaaggtggagagcaagacagagacagatcgatt
cgattagtacgaggattcttagcacttgcctgggacgacttgaggagcctgtgccttttc
agctaccaccgattgagagacttcatattgattgcagcgagagcagcggaacttctggga
catagcagtctcaggggactacagaggggtgggaaatccttaagtatctgggaagtctt
gcacaatattggggtctagaactcaaaaagagtgctattagtctgcttgacatcacagca
attgcagtagctgaaggaacagatagaattatagaattaatacaaagaatttggagagct
atccgcaatatacctacaagaataagacagggctttgaaacagctttgctataa
```

FIGURE 66 (SEQ ID NO:69)

```
atgagagtgaggggggatactgaggaattatcaacaatggtggatatgggccagcttaggc
ttttggatgttaatgagttataatgtggtggggaacttgtgggtcacagtctattacggg
gtacctgtgtggaaagaagcaaaaactactctattctgtgcatcagatgctaaaggatat
gaaaaagaagtgcataatgtctgggctacacatgcctgtgtacccacagaccccaaccca
caagaactggttgtggaaaatgtaacagaaaattttaacatgtggaaaaatgacatggta
gatcagatgcatgaggatataatcagtttatgggaccaaagcctaaagccatgtgtaaag
ttgaccccactctgtgtcactttaagatgtgtaaatgttaatgctaccagtaatgctacc
agtagtagtagtgctacctctgataatcccatgaatggagaaataaaaaattgctctttc
aatgtaaccacagaaataagggataggaaaaaggaagtgtatgcactttttttataaacct
gatgtagtatcacttgacaactctagtacatatagattaataaattgtaatacttcaacc
ctaacacaagcctgtccaaaagtcactttttgatccaattcctatacattattgtgctcca
gctggttatgcgattctaaagtgtaataataagacattcaatgggacaggaccatgcact
aatgtcagcacagtacaatgtacacatggaattaagccagtagtatcaactcaattactg
ttaaatggtagcctagcagaaaaagagataataattaaatctaaaaatctgacaaacaat
gcccaaacaataatagtacatcttaacgaatctatagaaattaggtgtccaagacccaac
cataatacaagacgaagtataaggataggaccaggacaagcattctatgcaacaggagac
ataataggagatataagacaagcacactgtaacattagcgaaagtaaatggaataaaact
ttacaaagggtaagtaaaaaattaggagaacacttccctaataaaacaataaaatttgca
ccacattcaggaggggacctagaaattacaacacatagctttaattgtagagggggaattt
ttctattgcaatacatcaaaactgtttaatagtacatacatgcctaatgttacagaaagt
aatggtacagaaagtaatgtaacgatgatcacactcccatgcagaataaagcaaattata
aacatgtggcaggaggtaggacgagcaatgtatgcccctcccattgcaggcaacataaca
tgtacatcaaacatcacaggactactattggtacgtgatggaggcacagaggataatacc
acagagatattcagacctggaggaggagatatgagagataattggagaaatgaactatac
aaatataaagtggtagaaattaagccattgggaatagcacccactacagcaaaaaggaga
gtggcggagagagaaaaaagagcagcaggactaggagctgtactccttggattcttggga
gcagcaggaagcactatgggcgcggcgtcaataacgctgacggtacaggccagacaattg
ttgtctggtatagtgcaacagcaaagcaatttgctgaaagctatagaggcgcaacagcat
gtgttgcagctcacggtctggggcattaagcagctccagacaagagtcctggctatagaa
agatacctaaaggatcaacagctcctaggaatttggggctgctctggaaaactcatctgc
accactgctgtgccttggaactccagttggagtaatagatctcaaacagatatttggaat
aacatgacctggatgcagtgggatagagaaattagtaattacacagacacaatatacaag
ttgcttgaagaatcgcaaaaccagcaggaaaataatgaaaaggatttattagcattgaac
agctggcaaaatctgtggagttggtttaacataacaaactggctgtggtatataagaatc
tttataatgatagtaggaggcttgataggtttaaggataattttttgctgtgatctctata
gtgaatagagttaggcagggatactcacctttgttgtctcagacccttaccccaaacccg
aggggacccgacaggctcggaagaatcgaagaagaaggtggagagcaagacaaagacaga
tccattcgattagtgagcggattcttgtcacttgcctgggacgatctgcggagcctgtgc
ctcttcagctaccaccgattgagagacttaatattgattgtagtgagagcggtggaactt
ctgggacgcagcagtctcagggggctgcagaggggtgggaagcccttaagtatctggga
ggccttgtatagtattggggtctggaactaaaaaagagtgctattagtctgtttgatacc
atagcaatagcagtagctgaaggaacagataggattatagaattagtacaaggaatttgt
agagctatcctcaacatacctagaagaataagacagggctttgaagcagctttgcaataa
aatgggtggcaagtggtcaaaaagaatcgaattcccgcggccgccatgcggccgggagca
tgcgacgtcgggccca
```

FIGURE 67 (SEQ ID NO:70)

```
atgagagtgaggggggatactgaggaattatcaacaatggtggatatgggccagcttaggc
ttttggatgttaatgagttataatgtggtggggaacttgtgggtcacagtctattacggg
gtacctgtgtggaaagaagcaaaaactactctattctgtgcatcagatgctaaaggatat
gaaaaagaagtgcataatgtctgggctacacatgcctgtgtacccacagacccccaaccca
caagaactggttgtggaaaatgtaacagaaaattttaacatgtggaaaaatgacatggta
gatcagatgcatgaggatataatcagtttatgggaccaaagcctaaagccatgtgtaaag
ttgacccccactctgtgtcactttaagatgtgtaaatgttaatgctaccagtaatgctacc
agtagtagtagtgctacctctgataatcccatgaatggagaaataaaaaattgctctttc
aatgtaaccacagaaataagggataggaaaaggaagtgtatgcactttttataaacct
gatgtagtatcacttgacaactctagtacatatagattaataaattgtaatacttcaacc
ctaacacaagcctgtccaaaagtcacttttgatccaattcctatacattattgtgctcca
gctggttatgcgattctaaagtgtaataataagacattcaatgggacaggaccatgcact
aatgtcagcacagtacaatgtacacatggaattaagccagtagtatcaactcaattactg
ttaaatggtagcctagcagaaaagagataataattaaatctaaaaatctgacaaacaat
gcccaaacaataatagtacatcttaacgaatctatagaaattaggtgtccaagacccaac
cataatacaagacgaagtataaggataggaccaggacaagcattctatgcaacaggagac
ataataggagatataagacaagcacactgtaacattagcgaaagtaaatggaataaaact
ttacaaagggtaagtaaaaaattaggagaacacttccctaataaaacaataaaatttgca
ccacattcaggaggggacctagaaattacaacacatagctttaattgtagaggggaattt
ttctattgcaatacatcaaaactgtttaatagtacatacatgcctaatgttacagaaagt
aatggtacagaaagtaatgtaacgatgatcacactcccatgcagaataaagcaaattata
aacatgtggcaggaggtaggacgagcaatgtatgcccctcccattgcaggcaacataaca
tgtacatcaaacatcacaggactactattggtacgtgatggaggcacagaggataatacc
acagagatattcagacctggaggaggagatatgagagataattggagaaatgaactatac
aaatataaagtggtagaaattaagccattgggaatagcacccactacagcaaaaggaga
gtggcggagagagaaaaaagagcagcaggactaggagctgtactccttggattcttggga
gcagcaggaagcactatgggcgcggcgtcaataacgctgacggtacaggccagacaattg
ttgtctggtatagtgcaacagcaaagcaatttgctgaaagctatagaggcgcaacagcat
gtgttgcagctcacggtctggggcattaagcagctccagacaagagtcctggctatagaa
agatacctaaaggatcaacagctcctaggaatttggggctgctctggaaaactcatctgc
accactgctgtgccttggaactccagttggagtaatagatctcaaacagatatttggaat
aacatgacctggatgcagtgggatagagaaattagtaattacacagacacaatatacaag
ttgcttgaagaatcgcaaaaccagcaggaaaataatgaaaggatttattagcattgaac
agctggcaaaatctgtggagttggtttaacataacaaactggctgtggtatataagaatc
tttataatgatagtaggaggcttgataggtttaaggataatttttgctgtgatctctata
gtgaatagagttaggcagggatactcacctttgttgtctcagacccttaccccaaacccg
aggggacccgacaggctcggaagaatcgaagaagaaggtggagagcaagacaaagacaga
tccattcgattagtgagcggattcttgtcacttgcctgggacgatctgcggagcctgtgc
ctcttcagctaccaccgattgagagacttaatattgattgtagtgagagcggtggaactt
ctgggacgcagcagtctcaggggctgcagagggggtgggaagcccttaagtatctggga
ggccttgtatag
```

FIGURE 68 (SEQ ID NO:71)

```
gtcgacaagagcagaagacagtggcaatgagagtgatggggatactgaggaattgtccac
aatggtggatatggggcatcttaagcttttggatgttaatgatttgtaatgtaggaggga
aattgtgggtcacagtctattatggggtacctgtgtggaagaagcaaaaactactctat
tctgtgcatctgatgctaaagcatatgagagggaggtgcataatgtttgggctacacatg
cctgtgtacccacagaccccaacccacaagaaatagtattggaaaatgtaacagaaaatt
ttaacatgtggaaaaatgacatggtggatcagatgcatgaggatataattagtttatggg
atcaaagcctaaaccatgtgtaaagttgacccactctgtgtcactttaaattgtagtg
atgttatcccagtaatgttaccaacactacagttacccacaataacatcacggataaag
aggaaatgagaaattgtacttttaatataaccacagaaataacagataagaaaagcaaag
agtatgcaattttttatagacttgatgtagtaccacttaatgagaaggataacaaatcta
ctgagtgtagattaataaattgtaatacctcaactgtaacacaagcctgtccaaaggtct
cttttgaaccaattcctatacattattgtgctccagctggttatgcgattctaaaatgta
ataataagacattcaatgggacaggaccatgcaataatgtcagtacaatacaatgtacac
atggaatcaagccagtggtatcaactcaactactgctaaatggtagcctagcagaaaaag
agataataattagatctgaaaatctgacagacaatgcaaaaacaataatagtacatctta
atgaatccatacgcattatgtgtacaagacccaataataatacaagaaaagtataagaa
taggaccaggacaaacattctttgcaacaaacgacataataggagacataagacaagcat
attgtaacattagtaaagatgactggaataaaaccttacaaaggatagctgagaaattag
gaaaacacttccctaataaaaacataacgtttagaccatcctcaggagggggacctagaaa
ttacaacacatagctttaattgtagaggggaattttttctattgcaatacatcaagactgt
ttaatcatacatacctgtttaatggtacaggcgtgcctaataataccacaccttctaatg
agaccatcatacttccatgcagaataaaacaaattataaacatgtggcaggaggtagggc
gagcaatgtatgcccctcccattgcaggaaacatcacatgtacatcaaacatcacaggac
tactattagtacgtgatggaggcaacagtggcaaaaataccacagaagagatattcagac
ctgggggaggaaatatgaaggacaattggagaagtgaattatataaatataaagtggtag
aaattaagccattaggaatagctcccactgcggcaaaaaggagagtggtggagagagaaa
aaagagcagtgggaataggggctgtgttccttgggttcttgggagcagcaggaagcacta
tgggcgcggcgtcaataacgctgacggtacaggccagacaattgttgtctggtatagtgc
aacagcaaagcaatttgctgagggctatagaggcgcaacagcatctgttgcaactcacag
tctggggcattaagcagctccagacaagagtcctggctatggaaagatacctacgggatc
aacagctcctaggaatttggggctgctctggaaaactcatctgcaccactaatgtgcctt
ggaacgccagttggagtaataaatctctaggagatatttgggataacatgacctggatgc
aatgggatagagaaattaataattacacaaacacaatatacaggttgcttgaagaatcgc
aaacccagcaggagcaaaatgaaaaagatttattagcattggacaaatggcaaaatctgt
ggagttggtttaacataacaaattggctgtggtatataaaaatattcataatgatagtag
gaggtttgataggtttaagaataattttgctgtgctatctatagtaaatagagttaggc
agggatactcacctttgtcgtttcagacccttatcccagacccgagggaccagacaggc
tcagaagaatcgaagaagaaggtggagagcaagacaaagacagatccgtgcgattagtga
gcggattcttagcacttgcctgggacgacctgcggagcctgtgccttttcagctaccacc
tattgagagactttatattggagtagcgagagtggtggaacttctgggacgcagcagtc
tcaggaaactacagagggggtgggaagcccttaagtatctgggaagtcttgtgcagtatt
ggggtctggaactagaaaagagtgctattagtctgcttgataccatagcaataacagtag
ctgggggggacagataggattatagaattcctacaacgaatttgtagagctatacgcaacc
tacctagaagaataagacatggctttgaagcagctttgcaataactctagaaagaaacaa
gggcgaattc
```

FIGURE 69 (SEQ ID NO:72)

```
gtcgacaagagcagacgacagtggcaatgagagtgatgggaatactgaggaattgtccac
aatggtggatatggggcatcttaagcttttggatgttaatgatttgtaatgtaggaggga
aattgtgggtcacagtctattatggggtacctgtgtggaaagaagcaaaaactactctat
tctgtgcatctgatgctaaagcatatgagagggaggtgcataatgtttgggctacacatg
cctgtgtacccacagaccccaacccacaagaaatagtattggaaaatgtaacagaaaatt
ttaacatgtggaaaaatgacatggtggatcagatgcatgaggatataattagtttatggg
atcaaagcctaaaaccatgtgtaaagttgaccccactctgtgtcactttaaattgtagtg
atgttatcccagtaatgttacagttacccacaataacatcatggataaagaggaaatga
gaaattgttcttttaatataaccacagaaataacagataagaaaagcaaagagtatgcaa
tttttatagacttgatgtagtaccacttaatgagaaggataacaaatctactgagtata
gattaataaattgtaatacctcaactgtaacacaagcctgtccaaaggtctcttttgaac
caattcctatacattattgtgctccagctggttatgcgattctaaaatgtaataataaga
cattcaatgggacaggaccatgcaataatgtcagtacaatacaatgtacacatggaatca
agccagtggtatcaactcaactactactaaatggtagcatagcagaagaagggataataa
ttagatctgaaaatctgacagacaatgctaaaacaataatagtacatcttaatgaatcca
tacgcattgtgtgtacaagacccaataataatacaagaaaaagtataagaataggaccag
gacaaacattctttgcaacaaacgacataataggagacataagacaagcatattgtaaca
ttagtaaagatgactggaataaaaccttacaaagggtagctgagaaattaggaaaacact
tccctaataaaaacataacgtttagaccatcctcaggaggggacctagagattacaacac
atagctttaattgtagaggagaattttctattgcaacacatcaagactgtttaatcata
cataccgtttaatggtacaggcatgcctaatagtaccacaccttctaatgagaccatca
tacttccatgcagaataaaacaaattataaacatgtggcaggaggtagggcgagcaatgt
atgcccctcccactgcaggaaacatcacatgtacatcaaacatcacaggactactattag
tacgtgatggaggcaacagtggcaacaataccacagaagagatattcagacctggaggag
gaaatatgagggacaattggagaagtgaattatataaatataaagtggtagaaattaagc
cattaggaatagctcccactgcggcaaaaggagagtggtggagagagaaaaaagagcag
tgggaataggagctgtgttccttgggttcttgggagcagcaggaagcactatgggcgcgg
cgtcaataacgctgacggtacaggccagacaattgttgtctggtatagtgcaacagcaaa
gcaatttgctgagggccatagaggcgcaacaacatctgttgcaactcacggtctggggca
ttaagcagctccagacaagagtcctggctatggaaagatacctaaaggatcaacagctcc
taggaatttggggctgctctggaaaactcatctgcaccactaatgtaccttggaacacca
gttggagtaataaatctctaagtgatatttgggataacatgacctggatacagtgggata
gagaaattaataattacacaagcacaatctacaggttgcttgaagaatcgcaaacccagc
aggaacaaaatgaaaaagatttattagcattggacaaatggcaaaatctgtggagttggt
ttaacataacaaattggctgtggtatataaaaatattcataatgatagtaggaggcttga
taggtttaagaataattttttgctgtgctatctatagtaaatagagttaggcagggatact
caccctttgtcgtttcagacccttatcccagacccgaggggaccagacaggctcagaagaa
tcgaagaagaaggtggagagcaagacaaagacagatccgtgcgattagtgagcggattct
tagcacttgcctgggacgacctgcggtgcctgtgccttttcagctaccacctattgagag
actttatattgggagtagcgagagtggtggaacttctgggacgcagcagtctcaggaaac
tacagagggggtgggaagcccttaagtatctgggaagtcttgtgcagtattggggtctgg
aactaaaaagagtgctattagtctgcttgataccatagcaataacagtagctggggga
cagataggattatagaattcctacaacgaatttgtagagctatacgcaacctacctagaa
gaataagacagggctttgaagcagctttgcaataactctagaaagaaacaagggcgaatt
c
```

FIGURE 70 (SEQ ID NO:73)

```
atgagagtgatggggatactgaggaattgtcaacaatggtggatgtggggcatcttaggc
ttttggatgatttgtaatgtggtggggaatttgtgggtcacagtctattatggggtacct
gtgtggaaagaagcaaaaactactctattctgtgcatcagatgctaaaggatatgagaaa
gaagtgcataatgtctgggctacacatgcctgtgtacccacagaccccaacccacaagaa
ttagttttagaaaatgtaacagaaaatttttaacatgtggaaaaatgacatggtggatcag
atgcatgaggatataatcagtttatgggatcaaagcctaaaagccatgtgtaaagttgac
cccactttgtgtcactttaagttgtacaaatgctactacctacatagcaccataggggac
gaaataaaaaattgctctttcaatacaaccacagtactaaaagataagacacagaaagtg
catgcacttttttataaacttgatgtagtaccacttaatgggagtaactctagtgagtat
agattaataaattgtaatacctcaaccataacacaagcctgtccaaaggtctcttttgac
ccaattcctatacattattgtgctccagctggttatgcgattctaaagtgtaataacaag
acattcaatgggacaggaccatgccaaaatgtcagcacagtacaatgtacacatggaatt
aaaccagtggtatcaacgcaactactgataaatggtagcctagcagaaggagagataatg
attagatctgaaaatttgacaaacaatgctaaaacaataatagtgcatttaatcaatct
atagaaattgtgtgtacaagacccaacaataatacaaggaaaagtgtaaggataggacca
ggacaaacattctatgcaacaggagacataataggagacataagagaagcacattgtaac
attagcaaagaaagtggaataacactttacaagaagtaagtaaaaaattaaaggaacac
taccctaataaaacaataacatttaaaccacactcaggaggggacccagaaattacaaca
catagctttatttgtagtggagaattttttctattgtaatacatcaggcctgtttaatggt
acatacatgcccaatggtacagacaagtctaatgatacatcacccatcacactcccatgc
agaataaaacaaattataaacatgtggcaggggggtaggacgagcaatgtatgccccgccc
attgcaggaaacataacatgtaaatcaaatatcacaggactactattgacacgtgatgga
ggagaaaataatagaactaatgagacattcagacctggaggaggagatatgagggacaat
tggagaagtgaattatataaatataaagtggtagaaattaaaccattgggaatagcaccc
actactgcaaaaaggagagtggtggagagagaaaaaagagcagtgggaataggagctatg
ttccttgggttcttgggaatggcaggaagcactatgggcgcggcgtcaataacgctgacg
gtacaggccagacaattgttgtctggtatagtgcaacagcaaagcaaattgctgagggcc
atagaggcgcaacagcatatgttgcaactcacggtctggggcattaagcagctccaggca
agagtcctggctataaaaagatacctaaaggatcaacagctcctaggactgtgggggctgc
tctggaaaactcatctgcaccactgctgtgccttggaactccagttggagtaataataag
tctcaaacagaaatttgggataacatgacctggatgcagtgggatagagaaattagtaat
tactcaaacacaatatacaggttgcttgaagaatcgcaaaaccagcaggaaaagaatgaa
aaggatttattagcattggacagttggaataatctgtggaattggtttagtataacaaag
tggttgtggtatataagaatattcataataatagtaggaggcttgataggtttaagaata
attttgcagtgatctctatagcgaatagagttaggcagggatactcacctctgtcgttg
cagacccttatcccagacccgaggggacccgacaggcccggaagaatcgaagaagaaggt
ggagagcaagacagagacagatccataagattagtgagcggattcttagcacttgcctgg
gacgatctgaggagcctgtgccttttctgctaccaccgattgagagacttcatattgatt
gcagcgagagtggtggaacttctgggacgcagcagtctcaggggactacagagggggtgg
gaagcccttaagtatctgggaagtcttgtgcagtattggggtctagagctaaaaaagagt
gctattagtctgcttgataccatagcaatagcaacagctgaaggaacagataggattata
gaattaatacaaggaattggtagagctatctacaatatacccagaagaataagacagggc
tttgaagcagctttgcaataa
```

FIGURE 71 (SEQ ID NO:74)

```
gtcgacaagagcagaagacagtggcaatgagagtgatggggagcaggaggaattatcaac
aatggtggatatggggaatcttaggcttttggatgctaatggttggtaatgtaatgggga
acttgtgggtcacagtctattatggggtacctgtgtggaagaagcaaaagctacgctat
tttgtgcatctgatgcaaaagcatatgagaaagaagtgcataatgtctgggctacacatg
cctgtgtacccacagaccccgacccacaagaaatagttttggagaatgtaacagaaaatt
ttaacatgtggaaaataacatggtggaccagatgcatgaggatataatcagcttatggg
atcaaagcctaaagccatgtgtaaagttgacccacttttgtgtcactttaaactgtagca
ataatgttaaaaatgctaccaacagtatgaaggaaatgaaaaattgcactttcaatataa
ccacagaactaagagataagagaaagcaagaatatgcacttttttataaacttgatatag
taccacttgaggagaattccagtaagtatagattaataaattgtaatacctcagccataa
cccaagcctgtccaaaggtctcttttgacccaattcctatacattattgtgctccagctg
gttatgcgattctaaagtgtaataataagacattcaatggaacaggaccatgcaataatg
tcagcactgtacagtgtacacatggaatcaagccagtagtatcaactcaactactgttaa
atggtagtctagcagaagaagaaatagtaattagatctgaaaatatgacaaacaatgcca
aaataataatagtacatcttaatgaatctgtagaaattacgtgtacaaggcccaacaata
atacaaggaaaagtatgaggataggaccaggacaaacattctatgcaacaggagacataa
taggagatataagacaagcacactgtaacattagtgaaaagcaatgggatcagactttat
acagggtaagtgaaaaattaaaagaacacttccctaataaaacaataaagtttaactcat
cctcaggaggggacttagaaattacaacacatagctttaattgtggaggagagttttttct
attgcaatacatcagcactgtttaatggcatatacagtaatggcacaaacagtacaaata
caacagtcatcacactccaatacagaataagacaaattataaacatgtggcaggggggtag
gacgagcaatgtatgcccctcccattgcaggaaacataacatgcagatcaaacatcacag
gactaatattgacacgtgatggaggtgaagggaatggcacgaatacggatgagatattta
gacctgcaggaggagatatgagggacaattggagaagtgaattatacaaatataaagtgg
tagaaattcagccattaggggtagcacccactaaggcaaaaaggagagtggtggagagag
aaaaaagagcagctttgggagctgtgttccttgggttcttgggagcagcaggaagcacta
tgggcgcggcatcaataacgctgacggtacaggccagacaactgttgtctggtatagtgc
aacagcaaagcaatttgctgagagctgtagaggcgcaacagcatatgttgcaactcacgg
tctggggcattaagcagctccagacaagagtcctggctatagaaagatacctaaaggatc
aacagctcctagggatttggggctgctctggaaaactcatctgcaccactgccgtgcctt
ggaacaatagttggagtaataaatctcaagattatatttggggaaacatgacctggatgc
aatgggataaagaaattaacaattacacagacacaatatacaggttgcttggggacgcgc
aaaaccagcaggaggaaaatgaaaaggagttactagaattggacaggtggggaaatctgt
ggaattggtttgacatgacaagctggctgtggtatataaaaatattcataatggtaatag
gaggcttgataggtttaagaataattttttgccgtgctttctatagtaaatagagttaggc
agggatactcacctttgtcatttcagacccttgcccaaaacccgaggggacccgacaggc
tcggaagaaccgaagaagaaggtggagagcaagacagagacagatccataagattagtga
gcggattcttagcacttgcctgggaggacttgaggaacctgtgcatcttcctctaccacc
gattgagggacttcgtattggtgacagcgagagcagtggaacttctgggacgcagcagtc
tcagggacttcagagggggtgggaaatccttaagtatttggggagtcttgtgcagtatt
ggggtctagagctaaaaaagagtgctgttagtctgcttgatagcttagcaatagcagtag
ctgagggaacagatagaattatagaattcttacaaggaattggtagagctatctacaata
tacctagaagaataagacagggctttgaagcagctttgcaataactctagaaagaaacaa
gggcgaattcc
```

FIGURE 72 (SEQ ID NO:75)

```
gtcgacaagagcagaagacagtggcaatgagagtgatggggagcaggaggaattatcaac
aatggtggatatggggaatcttaggcttttggatgctaatggttggtaatgtaatgggga
acttgtgggtcacagtctattatggggtacctgtgtggaaagaagcaaaagctacgctat
tttgtgcatctgatgcaaaagcatatgagaaagaagtgcataatgtctggctacacatg
cctgtgtacccacagaccccgacccacaagaaatagttttggagaatgtaacagaaaatt
ttaacatgtggaaaaataacatggtggaccagatgcatgaggatataatcagcttatggg
atcaaagcctaaagccatgtgtaaagttgaccccactttgtgtcactttaaactgtagca
ataatgttaaaaatgctaccaacagtatgaaggaaatgaaaaattgcactttcaatataa
ccacagaactaagagataagagaaagcaagaatatgcactttttataaacttgatatag
taccacttgaggagaattccagtaagtatagattaataaattgtaatacctcagccataa
cccaagcctgtccaaaggtctcttttgacccaattcctatacattattgtgctccagctg
gttatgcgattctaaagtgtaataataagacattcaatggaacaggaccatgcaataatg
tcagcactgtacagtgtacacatggaatcaagccagtagtatcaactcaactactgttaa
atggtagtctagcagaagaagaaatagtaattagatctgaaaatatgacaaacaatgcca
aataataatagtacatcttaatgaatctgtagaaattacgtgtacaaggcccaacaata
atacaaggaaaagtatgaggataggaccaggacaaacattctatgcaacaggagacataa
taggagatataagacaagcacactgtaacattagtgaaaagcaatgggatcagactttat
acagggtaagtgaaaaattaaaagaacacttccctaataaaacaataaagtttaactcat
cctcaggaggggacttagaaattacaacacatagctttaattgtggaggagagttttct
attgcaatacatcagcactgtttaatggcatatacagtaatggcacaaacagtacaaata
caacagtcatcacactccaatacagaataagacaaattataaacatgtggcaggggtag
gacgagcaatgtatgcccctcccattgcaggaaacataacatgcagatcaaacatcacag
gactaatattgacacgtgatggaggtgaagggaatggcacgaatacggatgagatattta
gacctgcaggaggagatatgagggacaattggagaagtgaattatacaaatataaagtgg
tagaaattcagccattaggggtagcacccactaaggcaaaaaggagagtggtggagagag
aaaaaagagcagctttgggagctgtgttccttgggttcttgggagcagcaggaagcacta
tgggcgcggcatcaataacgctgacggtacaggccagacaactgttgtctggtatagtgc
aacagcaaagcaatttgctgagagctgtagaggcgcaacagcatatgttgcaactcacgg
tctggggcattaagcagctccagacaagagtcctggctatagaaagatacctaaaggatc
aacagctcctagggatttggggctgctctggaaaactcatctgcaccactgccgtgcctt
ggaacaatagttggagtaataaatctcaagattatatttggggaaacatgacctggatgc
aatgggataaagaaattaacaattacacagacacaatatacaggttgcttggggacgcgc
aaaaccagcaggaggaaaatgaaaaggagttactagaattggacaggtggggaaatctgt
ggaattggtttgacatgacaagctggctgtggtatataaaaatattcataatggtaatag
gaggcttgataggtttaagaataattttttgccgtgctttctatagtaaatagagttaggc
agggatactcaccttttgtcatttcagacccttgcccaaaacccgaggggacccgacaggc
tcggaagaaccgaagaagaaggtggagagcaagacagagacagatccataagattagtga
gcggattcttagcacttgcctgggaggacttgaggaacctgtgcatcttcctctaccacc
gattgagggacttcgtattggtgacagcgagagcagtggaacttctgggacgcagcagtc
tcagggacttcagagggggtgggaaatccttaagtatttggggagtcttgtgcagtatt
ggggtctagagctaaaaaagagtgctgttagtctgcttgatagcttagcaatagcagtag
ctgagggaacagatagaattatagaattcttacaaggaattggtagagctatctacaata
tacctagaagaataagacagggcttgaagcagctttgcaataactctagaaagaaacaa
gggcgaattcc
```

FIGURE 73 (SEQ ID NO:76)

atgaaagtgagggagatacagaggaattggccacaatggtggatatggggcatcttaggc
ttttggatgataataatttgtagtggggtggggaacttgtgggtcacagtctattatggg
gtacctgtgtggaaagaagcaacaactactctattctgtgcatcagatgctaaagcatat
gagaaagaagtgcataatgtctgggctacacatgcctgtgtacccacagacccccaccca
caagaaatagttttggaaaatgtaacagaacattttaacatgtggaaaaatgacatggtg
gatcagatgcatgaggatataatcagtttatgggatcaaagtctaaaaccatgtgtaaag
ttgaccccactctgtgtcactttaaattgtacaaatgctatcaatacaaatgctaccagt
acaactactaccagtgcaactgctaccagtacaattgctaccagtacctatgataataat
ggagaaataaaaaattgctctttcaatacgaccacagaaataagagataagaaacagaac
acatatgcactttttatagatctgatatagtaccacttaataataggagtgagtatata
ttaataaattgtaatacctcaaccataacacaagcctgtccaaaggtctcttttgaccca
attcctatacattattgtgctcccgctggtttcgcgattctaaagtgtaataataagaca
ttcaatgggacaggaccatgccaaaatgtcagcacagtacaatgtacacatggaattaaa
ccagtggtatcaactcaactactgttgaatggtagcctggcagaagaggatataagaatt
agatctgaaaatctggaaaacaatatcaaaacaatagtagtccaccttaatcaatctgta
aaaattgtgtgtacaagacccaacaataatacaagaagaagtataaggataggaccagga
caagcattctatacaaatgacataataggagacataagacaagcacattgtaacattagt
agagctgagtggaacaacactctagctaaggtaaaggaaaaattagaaaaactctacaat
aaaacaatagtatttgaaccacactcaggagggatctagaaattacaacacatagcttt
aattgtagaggagaattcttctattgcaatacaacaaaactgtttaatataacagaagtg
cagaggaatgtaaatgatacaaatggcacactcacactcccatgcaggataaaacaattt
ataaacatgtggcaggaggtaggacgggcaatgtatgcccctcccattgcaggaaacata
acatgtagatcaaatatcacaggactactattgacacgtgatggaggaaacataacgaac
gagacagagacatctagacctggaggaggaaatatgaaagacaattggagaagtgaatta
tataaatataaagtggtagaaattaagccattgggaatagcacccactgaggcaaaaagg
agagtggtggagagagaaaaaagagcagtgggaataggagctgtgttccttgggttcttg
ggagcagcaggaagcactatgggcgcggcgtcaataacgctgacggtacaggccagacaa
ctgttgtctggtatagtgcaacagcaaagcaatttgctgagagctatagaggcgcaacag
catctgttgcaactcacagtctggggcattaagcagctccaggcaagagtcttggctata
gaaagatacctaaaggatcaacagctcctagggctttggggctgctctggaaaactcatc
tgcaccactgctgtgccttggaactccagttggagtaataaatctcaaacagatatttgg
gacaacatgacctggatgcagtgggatagaaaaattagtaattacacaggcataatatac
aggttgcttgaggactcgcaaacccagcaggaacaaaatgaaaaagatttattagcattg
gacagttggaaaaatctgtggacttggtttgacatatcaaagtggttgtggtatataaga
atattcatcatgatggtaggaggcttgataggtttaagaataattttaggtgtgctctct
atagtgaaaagagttaggcagggatactcacctttgtcgtttcagacccttatcccaaac
ccgagggaacccgacaggctcagagggatcgaagaagaaggtggagagcaagacaaagac
agatcaattcgattagtgagcggattcttagcacttgcctgggacgacctgcggagcctg
tgcctcttcagctaccaccaattgagagacttcatattgattgtggcgagagcagtggaa
cttctgggacagagcagtctcaggggactacagaggggggtgggaagcccttaagtatctg
ggaaatcttgtgcagtattggggtctggaactaaaaaagagtgctattagtctgcttgat
accatagcaatagcagtagctgaaggaacagataggattattgaaataatacagagaatt
tgtagagctatccgcaacatacctagaagaataagacagggctttgaagcagctttgcta
taa

FIGURE 74 (SEQ ID NO:77)

```
atgaaagtgagggagatacagaggaattggccacaatggtggatatggggcatcttaggc
ctttggatgataatentttgtagtggggtggggaacttgtgggtcacagtctattatggg
gtacctgtgtggaaagaagcaacaactactctattctgtgcatcagatgctaaagcatat
gagaaagaagtgcataatgtctgggctacacatgcctgtgtacccacagaccccgaccca
caagaaatagtttttggaaaatgtaacagaacattttaacatgtggaaaaatgacatggtg
gatcagatgcatgaggatataatcagtttatgggatcaaagtctaaaaccatgtgtaaag
ttgaccccactctgcgtcactttaaattgtacaaatgctatcaatacaaatgctaccagt
acaactactaccagtgcaactgctaccagtacaattgctaccagtacctatgataataat
ggagaaataaaaaattgctctttcaatacgaccacagaaataagagataagaaacagaac
acatatgcactttttatagatctgatatagtaccacttaataataggagtgagtatata
ttaataaattgtaatacctcaaccataacacaagcctgtccaaaggtctcttttgaccca
attcctatacattattgtgctcccgctggtttcgcgattctaaagtgtaataataagaca
ttcaatgggacaggaccatgccaaaatgtcagcacagtacaatgtacacatggaattaaa
ccagtggtatcaactcaactactgttgaatggtagcctagcagaagaggatataagaatt
agatctgaaagtctggaaaacaatatcaaaacaataatagtccaccttgatcaatctgta
aaaattgtgtgtacaagacccaacaataatacaagaagaagtataaggataggaccagga
caagcattctatacaaatgacataataggagacataagacaagcacattgtaacattagt
agagctgagtggaacaacactctagctaaggtaaaggaaaaattagaaaaactctacaat
aaaacaatagtacttgaaccacactcaggaggggatctagaaattacaacacatagcttt
aattgtagaggagaattcttctattgcaatacaacaaaactgtttaatataacagaagtg
cagaggaatgtaaatgatacaaatggcacactcacactcccatgcaggataaaacaattt
ataaacatgtggcaggaggtaggacgggcaatgtatgcccctcccattgcaggaaacata
acatgtagatcaaatatcacaggactactattgacacgtgatggaggaaacataacgaac
gagacagagacatttagacctggaggaggaaatatgaaagacaattggagaagtgaatta
tataaatataaagtggtagaaattaggccattgggaatagcacccactgaggcaaaaagg
agagtggtggagagagaaaaaagagcagtgggaataggagctgtgttccttgggttcttg
ggagcagcaggaagcactatgggcgcggcgtcaataacgctgacggtacaggccagacaa
ctgttgtctggtatagtgcaacagcaaagcaatttgctgagagctatagaggcgcaacag
catctgttgcaactcacagtctggggcattaagcagctccaggcaagagtcttggctata
gaaagataccctaaaggatcaacagctcctagggctttggggctgctctggaaaactcatc
tgcaccactgctgtgccttggaactccagttggagtaataaatctcaaacagatatttgg
gataacatgacctggatgcagtgggatagagaaatcagtaattacacaggcataatatac
aggttgcttgaagactcgcaaacccagcaggaacaaaatgaaaaagatttattagcattg
gacagttggaaagatctgtggacttggtttgacatatcaaagtggttgtggtatataaga
atattcatcatgatagtaggaggcttgataggtttaagaataatttttaggtgtgctctct
atagtgaaaagagttaggcagggatactcacctttgtcgtttcagacccttatcccaaac
ccgagggaacccgacaggctcagaggaatcgaagaagaaggtggagagcaagacaaagac
agatcaattcgattagtgagcggattcttagcacttgcctgggacgacctgcggagcctg
cgcctcttcagctaccaccaattgagagacttcatattgattgtggcgagagcagtggaa
cttctgggacagagcagtctcaggggactacagaggggggtgggaagcccttaagtatctg
ggaaatcttgtgcagtattggggtctggaactaaaaaagagtgctattagtctgcttgat
accatagcaatagcagtagctgaaggaacagataggattgttgaaataatacagagaatt
tgtagagctatccgcaacatacctagaagaataagacagggctttgaagcagctttgcta
taa
```

FIGURE 75 (SEQ ID NO:78)

```
gtcgacaagagcagaagacagtggcaaggagtgaggggggatacagaggaattggcaacaa
tggtggatatggggcatcttaggctttttggatgttaatgatttgtaatgtgttgggaaac
ttgtgggtcacagtgtattatggggtacctgtgtggaaagaagcaataactactctattc
tgtgcatcaaatgctaaagcatatgagagggaggtgcataatgtctgggctacacatgcc
tgtgtacccacagaccccaacccacaagaaatagttttgggaaatgtaacagaaaatttt
aatatgtggaaaaatgacatggtggatcaaatgcatgaggatataatcagtttatgggat
caaagcctaaagccatgtgtaaagttgacccactctgtgtcactttagaatgtacaggg
gttaaggctaccaataatagtagtgccaccaatagtagtaatgttaccaacaatgatgaa
ataaaaattgctctttcaatgcaaccacagaaataaaagacaagaagcacaaagagtat
gcactttttataggctcgatatagtaccacttaataatggcaaccctagtgagggcaat
tctagtgagaagtatagattaataaattgtaatacctcaaccttaacacaagcctgtcca
aaggtctcttttgacccaattcctatacattattgcactccagctggttatgcgattcta
aagtgtaataataagacattcaatgggacaggaccatgccataatgtcagtacagtacaa
tgtacacatggaattaaaccagtggtatcaactcaactactgttaaatggtagcttagca
gaagaagagataataattagatctgaaaatctgacaaacaatgctaaaataataatagta
cagcttaataaatctgtagaaattgtgtgcacaagacccggcaataatacaagaaaaagt
gtaaggataggaccaggacaaacattctatgcaacaggtgacataataggagacataaga
caagcacattgtaacattactgaagataagtggaatgaaactttacaatgggtaggtaaa
aaattaggagagctcttccctaataaaacaatagaatttaagccatcctcaggaggggac
ctagaaattacaacacatagctttaattgtagaggagaatttttctattgcaatacatca
caactatttaatagtacatacaattctacacaaatgcataatgatacaggaagtaattca
accatcacactcccatgcaaaataaagcaaattataaacatgtggcaggggggtaggacgg
gcaatgtatgcccctcccattgcaggaaacataacatgtaaatcaaatattacaggaata
ctattagtacgtgatggaggcaacacaaatgacacaaatggcacaggaatattcagacct
ggaggaggagatatgaaggacaattggagaagtgaattatataaatataaagtggtagaa
attaagccattgggaatagcacccactgaagcaaaaaggagagtggtggagagagaaaaa
ggagcagtaggaataggagctgtactccttgggttcttgggagcagcaggaagcactatg
ggcgcagcgtcaataacgctgacggtacaggccaggcaattgttgtctggcatagtgcaa
cagcaaagcaatttgctgagagctatagaggcgcaacagcatatgttgcaactcacggtc
tggggcattaagcagctccaggcaagagtcctggctatagaaagatacctacaggatcaa
cagctcctaggactttggggctgctctggaaaactcatctgcaccactactgtgccttgg
aactcaagttggagtaataaatctctaactgatatttgggataacatgacatggatgcag
tgggatagagaaattaataattacacaaccacaatataccagttgcttgaaaaatcgcaa
atccagcaggaacaaaatgagaaagatttattagcattggacaagtggcaaaatctgtgg
aattggtttagcataacacagtggctatggtatataaaaatattcatcatgatagtagga
ggcttgataggtttaagaataattttttgctgtgctatctatagtaaacagagttaggcag
ggatactcacctctgtcatttcagacccttaccccaaacccgaggggacccgacaggctc
ggaagaatcgaagaagaaggtggagagcaagacagagagagatccattcgattagtgagc
ggattcttctcacttgcttgggacgatctgcggaacctgtgcctcttcagctaccaccga
ttgagagacttcatattgattgcgacaagagtggtggaacttctggggcgcaggggtgg
gaaacccttaaatatctaggaagtcttgggcagtattggggtctggaactaaaaaagagt
gctattagtctgcttgatgccatagcaatagcagtagctgagggaacagataggattata
gaattcatacaaagaatttgtagggctatccgcaacacacctagaagaataagacatggc
ttttaagcagctttgcaataactctagaaagaaacaagggcgaattcc
```

FIGURE 76 (SEQ ID NO:79)

gtcgacaagagcagaagacagtggcaatgagagtgaggggatacagaggaattggcaac
aatggtggatatggggcatcctaggcttttggatgttaatgatttgtaatgtgttgggaa
acttgtgggtcacagtgtattatggggtacctgtgtggaaagaagcaaaaactactctat
tctgtgcatcagatgctaaagcatatgagagggaggtgcataatgtctgggctacgcatg
cctgtgtacccacagaccccaacccacaagaaatagttttgggaaatgtaacagaaatt
ttaatatgtggaaaaatgacatggtggatcaaatgcatgaggatataatcagtttatggg
atcaaagcctaaagccatgtgtaaagttgacccactctgtgtcactttagaatgtacag
gggttaaggctaccaataatagtagtgccaccaatagtagtaatgttaccaacaaagatg
aaataaaaattgctctttcaatgcaaccacagaaataaaagacaagaagcacaaagagt
atgcacttttttataggctcgatatagtaccacttaataatggcaaccctagtgagggca
attctagtgagaagtatagattaacaaattgtaatacctcaaccttaacacaagcctgtc
caaaggtctcttttgacccaattcctatacattattgcactccagctggttatgcgattc
taaagtgtaataataagacattcaatgggacaggaccatgccataatgtcagtacagtac
aatgtacacatggaattaaaccagtggtatcaactcaactactgttaaatggtagcttag
cagaagaagagataataattagatctgaaaatctgacaaacaatgctaaaataataatag
tacagcttaataaatctgtagaaattgtgtgcacaagacccggcaataatacaagaaaaa
gtgtaaggataggaccaggacaaacattctatgcaacaggtgacataataggagacataa
gacaagcacattgtaacattactgaagataaatggaatgaaactttacaatgggtaggta
aaaattaggagagctcttccctaataaaacaatagaatttaagccatcctcaggaggggg
acctagaaattacaacacatagctttaattgtagaggagagtttttctattgcaatacat
cacaactatttaatagtacatacaattctacacaaatgcataatgatacaggaagtaatt
caaccatcacactcccatgcaaaataaagcaaattataaacatgtggcaggggggtaggac
gggcaatgtatgcccctcccattgcaggaaacataacatgtaaatcaaatattacaggaa
tactattagtacgtgatggaggcaacacaaatgacacaaatggcacagaaatattcagac
ctggaggaggagatatgaaggacaattggagaagtgaattatataaatataaagtggtag
aaattaagccattgggaatagcacccactgaagcaaaaggagagtggtggagagagaaa
aaagagcagtaggaataggagctgtactccttgggttcttgggagcagcaggaagcacta
tgggcgcagcgtcaataacgctgacggtacaagccaggcaattgttgtctggcatagtgc
aacagcaaagcaatttgctgagagctatagaggcgcaacagtatatgttgcaactcacgg
tctggggcattaagcagctccaggcaagagtcctggctatagaaagataccacaggatc
aacagctcctaggactttggggctgctctggaaaactcatctgcaccactactgtgcctt
ggaactcaagttggagtaataaatctctaactgatatttgggataacatgacatggatgc
agtgggatagagaaattaataattacacaaccacaatataccagttgcttgaaaaatcgc
aaatccagcaggaacaaaatgagaaagatttattagcattggacaagtggcaaaatctgt
ggaattggtttagcataacacagtggctatggtatataaaaatattcatcatgatagtag
gaggcttgataggtttaagaataattttgctgtgctatctatagtaaacagagttaggc
agggatactcacctctgtcatttcagacccttaccccaaacccgaggggacccgacaggc
tcggaagaatcgaagaagaaggtggagagcaagacagagagagatccattcgattagtga
gcggattcttctcacttgcttggacgatctgcggaacctgtgcctcttcagctaccacc
gattgagagacttcatattgattgtgacgagagtggtggaacttctgggcgcaggggggt
gggaaacccttaaatatctaggaagtcttgggcagtattggggtctggaactaaaagga
gtgctattagtctgcttgatgccatagcaatagcagtagttgagggaacagataggatta
tagaattcatacaaagaatttgtagggctatccgtaacacacctagaagaataagacagg
gctttgaagcagctttgcaataactctagaaagaaacaagggcgaattcc

FIGURE 77 (SEQ ID NO:80)

```
atgagagtga tggggatcaa gaggaattgt caacaatggt ggatatgggg catcttaggc
ttttgggtgc ttatgatttg taatgtaatg gggaacttgt gggtcacagt ctattatggg
gtacctgtgt ggagagaagc aaaaactaca ctattctggg catcagatgc taaagcatat
gagaagaag tgcataatgt ttgggctaca catgcctgtg tacccacaga ccccaaccca
caagaaatag ttttggaaaa tgtaacagaa aattttaaca tgtgggaaaa taacatggta
gaccagatgc atgaggatat aatcagttta tgggatcaaa gtctaaaacc atgtgtaaag
ttgaccccac tctgtgtcac tttaaattgt agaaatgtaa cggttactac taacaatgat
aataatgtta cttacaataa tagcatacct gaagaaataa aaaattgctc tttcaatata
accacagaaa taagagacaa gaaaaagata gaatatgcac ttttttatag acttggtata
gtaccgctta aggagaacaa acttaattcc agtgagtata gattaataaa ttgtaatacc
tcagccataa cacaagcctg tccaaaggtc tcttttgacc caattcctat acattattgt
gctccagctg gttatgcgat actaaagtgt aataataaga cattcaatgg aacaggacca
tgcaataatg tcagcactgt acagtgtaca catggaatta agccagtggt atcaactcaa
ctactgttaa atggtagtct agcagaggaa gagataataa ttagatctaa aaatatgaca
aacaatgtca aaacaataat agtacatctg aatgaatctg tagaaattgt gtgtacaagg
cccaacaata atacaagaag aagtatgagg ataagaccag gacaaacatt ctatgcaaca
ggagaaataa taggagacat aagacaagca tattgtaaaa ttagtgaaga tcaatggaat
aaaactttac gcagggtaag tgaaaaatta agagaacact ccctgataa aacaataaaa
tttgaaccac cctcaggagg agacttagaa attacaacac atagctttaa ttgtagagga
gaatttttct attgcaatac atcagaactg tttaatagta catacatgcc taatggtaca
gaaagtaata caagcaaaac catcatactc ccatgcagaa taaaacaaat tataaatatg
tggcaggggg taggacgagc aatgtatgcc cctcccattg caggaaacat aacatgtcaa
tcaaatatca caggaatact attgacccgt gatggaggag aagagtcaaa gtcaaatgga
acagagatat tcaggcctgc aggaggggat atgaaggaca attggagaag tgaattatat
agatataaag tggtagaaat taaaccatta ggagtagcac ccactgaggc aaaaaggaga
gtggtggaga gagaaaaaag agcagtggga ataggagctg tgttccttgg gttcttggga
gcagcaggaa gcactatggg cgcggcgtca ataacgctga cggtacaggc cagacaaccg
ttttctggta tagtgcaaca gcaaagcaat ttgctgaggg ctatagaggc gcaacagcat
atgttgcaac tcacagtctg gggcattaag cagctccaga caagagtcct ggctgtagaa
agatacctaa aggatcaaca gctcctaggg ctttggggct gctctggaaa actcatctgc
accactgccg tgccttggaa ctccagttgg agtaataagt ctcaaacaga tatttgggat
aacatgacat ggatgcagtg ggatagagag atcagtaact acacagaaac aatatacaag
ttgcttgaag actcgcaaaa ccagcaggaa caaatgaaa aggatttact agcattggac
agttggaaaa atctgtggaa ttggtttgat ataacaaaat ggctgtggta tataaaaata
ttcataatga tagtaggagg cttgataggt ttaagaataa ttttttgctgt gctatctata
ataaatagag ttaggcaggg atactcacct ttgtcattac agacccttac cccaaacccg
aggggaccag acaggctcgg aagaatcgaa gaagaaggtg gagagcaaga cagagacaga
tccgtgagat tagtgaacgg attcttagca cttgtctggg acgacctgcg gagcctgtgc
ctcttcagct accaccaatt gagagactta atattgattg tagcgagagc agtggaagtt
ctgggacgca acagtctcag gggactacag acggggtggg aagctcttaa gtatctggga
aaccttgtgc tgtattgggg tctggagctg aaaaggagcg ctattagtct gttggataca
acagcaatag tagtagctga aggaacagat aggattttgg aagcaatatg cagaatttgt
agagctatcc gtaacatacc tagaagaata agacggggct tgaagcagc tttgctataa
```

FIGURE 78 (SEQ ID NO:81)

```
ggatccacta gtaacggccg ccagtgtgct ggaattcgcc cttccacgcg tcgacaagag
cagaagacag tggcaatgag agtgcagggg atactgagga attgtcaaca atggtggaca
tggggcatct taggcttttg gataataatg acttgtaatg tggtgggaaa cttgtgggtc
acagtttatt atggggtacc tgtgtggaaa gaagcaaaaa ctactctatt ctgtgcatca
gatgctaaag catatgagaa agaagtgcat aatgtttggg ctacacatgc ctgtgtaccc
acagacccca acccacaaga aatagttttg gaaaatgtaa cagaaaattt taatatgtgg
aaaaatgata tggtggatca gatgcatgag gatgtaatca gtttatggga ccaaagccta
aagccatgtg taaagttgac cccactttgt gtcactttaa attgtacaga tgttgataaa
aatagtactg aaatgtatag gaaaaccaca aatgataatg gtaatgatac catagataga
gaaatgaaaa attgctcttt caatgcaacc acagacatac aagataagaa aacgggagtg
tatgcacttt tttatcgact ggatatagta ccactcaatg atactaacaa ctctagggag
tatagattaa taaattgtaa tacctcaacc atgacacaag cctgtccaaa ggtctctttt
gatccaattc ctatacatta ttgtactcca gctggttatg cgattctaaa gtgtaataat
aagacattca gtgggacggg accatgcaat aatgtcagca cagtacaatg tacacatgga
attaagccag tggtatcaac tcaactactg ttaaatggta gcctagcaga aaaagagata
ataattagat ctaaaaatct gacagacaat gccaaaacaa taatagtaca tcttaatgaa
tctatagcaa ttatgtgtac aagacctggc aataatacaa gaaaaagtat aaggatagga
ccaggacaag cattctttgc aacaggagca ataataggag atataagaaa agcatattgt
aacattagcg aaggtgaatg gaatagaact ttacaaaggg taggtagaaa attagcagaa
cacttccctg gtaaaagaat aagatttgca ccaccttcag gaggggacct ggaaattaca
acacatagct ttaattgtgg aggagaattt ttctattgca atacaacaca actgtttaat
aggacataca atacaacaca actgtttaat ggtacataca gctctaacga tacagaaagt
aatttcacac tcccatgcag aataaaacaa attataaaca tgtggcagga ggtaggacga
gcaatgtatg ctcctcctat aaaaggaaac ataacatgta actcaaatat cacaggatta
ctgttggtgc gtgatggagg agaagacaat aacacagaaa atgacacaga gaccttcaga
cctggaggag gagatatgag ggacaattgg agaagtgaat tatacaaata taaagtggta
gaaattaagc cattgggaat agcacctact ggggcaaaaa ggagagtggt ggagagagaa
aaaagagcag tgggaatagg agctgtgttc cttgggttct tgggagcagc aggaagcact
atgggcgcgg cgtcaataac gctgacggta caggccagac aattattgtc tggtatagtg
caacagcaaa gcaatttgct gagggccata gaggcgcaac aacatatgtt gcaactcaca
gtctggggca ttaaacagct ccagacaaga gtattggcca tcgaaagata cctaaaggat
caacagctcc taggaatttg gggctgctct ggaaaactca tctgcaccac tgctgtgcct
tggaactcca gttggagtaa tagaactgag ggagatattt ggaataacct gacctggatg
caatgggata gagaaattag taattactca gacacaatat acaggttgct tgaagcatcg
caaaaccagc aggaacaaaa tgaaaaggat ttattggcct tgagcaattg gcaaaatctg
tggagttggt ttaacatatc aaattggctg tggtatataa gaatattcat aatgatagta
ggaggcttga taggtttaag aataattttt gctgtgctct ctttagtgaa taaagttagg
cagggatact cacctttgtc gttgcagacc cttaccccga acccaagggg acccgacagg
ctcagaggaa tcgaagaaga aggtggagag caagacagag acagatccgt tcgattagtg
agcggattct tagcacttgc ttgggacgac ctgcggagcc tgtgcctttt cagctaccac
caattgagag acttcatatt gattgtagcg agagcggtgg aaattctggg acgcaggggg
tgggaagccc ttaaatatct gggaagtctt gtgcagtact ggggtctgga acttaaaaag
agtgctatta atctgcttga tactatagca atagcagtag ctgaaggaac agataggatt
atagaattaa tactaggact tggtagagct atctgcaaca tacctagaag aataagacag
ggctttgaag cagctttgca ataactctag actagctaag gcgaattctg cagatatcc
atcacactgg cggccgc
```

FIGURE 79 (SEQ ID NO:82)

```
atgggtgcga gagcgtcaat attaagcggc ggaaaattag ataaatggga aagaattagg
ttaaggccag ggggaaagaa acattatatg ttaaaacatc tagtatgggc aagcagggag
ctggaaagat ttgcacttaa ccctggcctg ttagaaacat cagaaggctg taaacaaata
ataaaacagc tacaaccagc tcttcagaca ggaacagagg aacttagatc attattcaac
acagtagcaa ctctctattg tgtacataaa gggataaagg tacgagacac caaggaagcc
ttagacaaga tagaggaaga acaaaacaaa tgtcagcaaa aagcacagca ggcaaaagcg
gctgacgaaa aggtcagtca aaattatcct atagtacaga atgcccaagg gcaaatggta
caccaagcta tatcacctag aacattgaat gcatgggtaa aagtaataga ggagaaggct
ttcaacccag aggtaatacc catgtttaca gcattatcag aaggagccac cccacaagat
ttaaacacca tgttaaatac agtggggga catcaagcag ccatgcaaat gttaaaagat
accatcaatg aggaggctgc agaatgggat aggacacatc cagtgcatgc agggcctgtt
gcaccaggcc agatgagaga accaagggga agtgacatag caggaactac tagtacccctt
caggaacaaa tagcatggat gacaagtaat ccacctattc cagtaggaga catctataaa
agatggataa ttctggggtt aaataaaata gtaagaatgt atagccctgt cagcatttg
gacataaaac aagggccaaa agaaccctt agagattatg tagatcggtt ctttaaaact
ttaagagctg aacaagctac acaagatgta aaaaattgga tgacagacac cttgttggtc
caaaatgcga acccagattg taagaccatt ttaagagcat taggaccagg ggcttcatta
gaagaaatga tgacagcatg tcagggagtg ggaggaccta gccataaagc aagggtgttg
gctgaggcaa tgagccaaac aaacagtaac atactagtgc agagaagcaa ttttaaggc
cctaacagaa ttgttaaatg tttcaactgt ggcaaagtag ggcacatagc cagaaagtgc
agggccccta ggaaaagg ctgttggaaa tgtggacagg aagggcacca aatgaaagac
tgtactgaga ggcaggctaa ttttttaggg aaaatctggc cttcccacaa ggggaggcca
gggaatttcc tccagaacag accagagcca acagccccac cagcagagcc aacagcccca
ccagcagaga gcttcaggtt cgaggagaca accccgtgc cgaggaagga gaaagacagg
gaacctttaa cttccctcaa atcactcttt ggcagcgacc cctcgtcaca ataa
```

FIGURE 80 (SEQ ID NO:83)

```
atgggtgcga gagcgtcaat attaagcggc ggaaaattag ataaatggga aagaattagg
ttaaggccag ggggaaagaa acattatatg ttaaaacatt tagtatgggc aagcagagag
ctggaaagat ttgcacttaa ccctggcctg ttagagacag cagaaggctg taaacaaata
ataaaacagc tacaaccagc tcttcagaca ggaacagagg aacttagatc attattcaac
acagtagcaa ctctctattg tgtacataaa ggaatagagg tacgagacac caaggaagcc
ttagacaaga tagaggaaga acaaaacaaa tgtcaacaaa aggcacaaca ggcaaaagcg
gctgatgaaa aggtcagtca aaattatcct atagtacaga atgcccaagg gcaaatggta
caccaagcta tatcacctag aacattgaat gcatgggtaa aagtaataga ggagaaggct
ttcaacccag aggtgatacc catgtttaca gcattatcag aaggagccac cccacaagat
ttaaacacaa tgttaaatac agtggggga catcaagcag ccatgcaaat gttaaaagat
accatcaatg aggaggctgc agaatgggat aggacacatc cagtgcatgc agggcctgtt
gcaccaggcc agatgagaga accaagggga agtgacatag caggaactac tagtaccctt
caggaacaaa tagcatggat gacaagtaat ccacctattc cagtaggga catctataaa
agatggataa ttctggggtt aaataaaata gtaagaatgt atagccctgt tagcattttg
gacataaaac aagggccaaa agaacccttt agagattatg tagatcggtt ctttaaaact
ttaagagctg aacaagctac acaagatgta aaaaattgga tgacagacac cttgttggtc
caaaatgcga acccagattg taagaccatt ttaagagcat taggaccagg ggcttcatta
gaagaaatga tgacagcatg tcagggagtg ggaggaccta gccataaagc aagggtgttg
gctgaggcaa tgagccaaac aaacagtaac atactagtgc agagaagcaa ttttaaaggc
tctaacagaa ttgttaaatg tttcaactgt ggcaaggtgg ggcacatagt cagaaattgc
agggccccta ggaaaaaggg ctgttggaaa tgtggacagg aagggcacca aatgaaagac
tgtactgaga gacaggctaa tttttaggg aaaatctggc cttcccacaa ggggaggcca
gggaatttcc tccagaacag accagagcca acagccccac cagcagaacc aacagcccca
ccagcagaga gcttcaggtt cgaggagaca accccgtgc cgaagaggga gaaagagagg
gaacctttaa cttccctcaa atcactcttt ggcaacgacc cctcgtcaca ataa
```

FIGURE 81 (SEQ ID NO:84)

```
atgggtgcga gagcgtcagt attgaaaggg aaaaaattag atacatggga aagaattagg
ttaaggccag ggggaaagaa acactatatg ctaaaacacc tagtatgggc aagcagggag
ctggaaagat ttgcacttaa ccctggcctt ttagaaacag cagaaggctg taaacaaata
atgcaacagc tacaatcagc tcttcagaca ggaacagagg aacttagatc attatataac
acagtagcaa ctctctattg tgtacataaa gagatagatg tacgagacac caaggaagcc
ttagacaaga tagaggaaga acaaaataag agtcagcaaa aaacacagca agcagaagcg
gctgacaaag gaaaggtcag tcaaaattat ccaatagtgc agaatctcca agggcaaatg
gtacaccagg ccatatcacc gagaacttta aatgcatggg taaaagtaat agaagagaag
gctttcagcc cagaggtaat acccatgttt acagcattat cagaaggagc tacccacaa
gatttaaaca ccatgttaaa tacagtgggg ggacaccaag cagccatgca aatgttaaaa
gataccatca atgaggaggc tgcagaatgg gataggttac atccagtgca tgcagggcct
attgcaccag gccaaatgag agaaccaagg ggaagtgaca tagcaggaac tactagtacc
cttcaagaac aaatagcatg gatgacaagt aacccaccta ttccggtggg agacatctat
aaaagatgga taattctggg gttaaataaa atagtaagaa tgtatagccc tgtcagcatt
ttggacataa aacaagggcc aaaagaaccc tttagagact atgtagaccg attctttaaa
actttaaggg ctgaacaatc ttcacaagag gtaaaaaatt ggatgacaga caccttgttg
gtccaaaatg caaacccaga ttgtaagacc attttaagag cattaggacc aggggctaca
ttagaagaaa tgatgacagc atgtcaggga gtgggaggac ctggccacaa agcaagagtt
ttggctgagg caatgagcca agcaaataca aacataatga tgcagaaaag caattttaaa
ggccctaaaa gaactgttaa atgtttcaat tgtggcaagg aagggcatat agccagaaat
tgcagggccc ctaggaaaaa gggctgttgg aaatgtggaa aggaaggaca ccaaatgaaa
gactgtactg aaaggcaggc taatttttta gggaaaattt ggccttccta caggggagg
tcgggaatt ccttcagag cagaccagag ccatcagctc caccagcaga gagcttcagg
ttcgaggagc gggagccgaa agacaaggaa ccaccttaa cttccctcaa atcactcttt
ggcagcgacc cctcgtcaca ataa
```

FIGURE 82 (SEQ ID NO:85)

```
atgggtgcga gagcgtcaat attaagaggg ggaaaattag ataaatggga aaaaattagg
ttaaggccag ggggaaagaa acgctatatg ataaaacacc tagtatgggc aagcagagag
ctggaaaaat tcgcacttaa ccctggcctt ttagagacat cagaaggatg taaacagata
atgaaacagc tacaaccagc tcttcagaca ggaacagagg aacttagatc attattcaac
accatagcag ttctctattg tgtacatgaa aagatagagg tacaagacac caaggaagcc
ttagacaaga tagaggaaga acaaaacaaa agtcagcaaa aaacacagca ggcagcagca
gctgacggaa aagtcagtca aaattatcct atagtgcaga atgcccaagg gcaaatggtg
caccagagca tatcacctag gactttgaat gcatgggtaa aagtaataga ggagaaggct
tttagcccag aggtaatacc catgtttaca gcattatcag aaggagccac ctcacaagac
ttaaacacca tgctaaatac agtggggga catcaagcag ccatgcaaat gttaaaagat
accatcaatg aggaggctgc agaatgggat agaatacatc cagtacatgc ggggcctatt
gcaccaggcc aaatgagaga accaagggga agtgacatag caggaactac tagtaccctt
caggaacaaa tagcatggat gacaagtaat ccacctatcc cagtgggaga catctataaa
agatggataa ttttggggtt aaataaaata gtaagaatgt atagccctgt cagcattttg
gacataaaac aagggccaaa ggaacccttt agagactatg tagacaggtt ctttaaaact
ttaagagctg aacaagctac acaagatgta aaaaattgga tgacagaaac cttgttggtc
caaaatgcaa acccagattg taagaccatt ttaagagggt taggaacagg ggctacatta
gagggaatga tgacagcatg tcagggagtg ggaggacctg gccataaagc aagagtgtta
gctgaagcaa tgagccaagc aacatataac ataatgatgc agagaagcaa ttttaaaggc
tctagaaaaa ttgttaaatg tttcaactgt ggcaggaaag gcacatagc cagaaattgc
agggcccta gaaaaaaggg ctgttggaaa tgtggaaagg aaggacacca aatgagagaa
tgtactgaaa agcaggctaa ttttttaggg aaaatttggc cttcccacaa ggggaggcca
gggaatttcc ttcagcagac cagagcca acagccccac cagcagagag cttcaggttc
gaggagacac ccccgcgat gaagcaggaa ccgaaagaca gggaacccttt aacttccctc
aaatcactct tggcagcga ccctcgtca caataa
```

FIGURE 83 (SEQ ID NO:86)

```
atgggtgcga gagcgtcaat attaagaggg ggaaaattag ataaatggga aaaaattagg
ttaaggccag ggggaaagaa acattatatg ataaaacacc tagtatgggc aagcagggag
ctggaaagat ttgcacttaa ccctggcctt ttagagacag cagagggctg taaacaaata
ataaaacagc tacatccagc tcttcagaca ggaacagagg aacttagatc attatacaac
accgtggtaa ctctttattg cgtacatgca gagatagagg tacgagacac caaggaagcc
ttagacaaga tagaggaaga acaaaacaaa agtcagcaaa aaacacagca ggcaaaagcg
gctgacggaa aagtcagtca aaattatcct atagtacaga atctccaagg gcgaatggta
caccaagcca tatcacctag aaccttgaat gcatgggtaa aagtaataga ggaaaaggct
tttagcccag aggtaatacc catgtttaca gcattatcag aaggagccac cccccaagac
ttaaacacca tgttaaatac agtggggggga catcaagcag ccatgcaaat gttaaaagat
accatcaacg aggaggctgc agaatgggat agattacatc cagcacaggc agggcctgtt
gcaccaggcc aaataagaga accaagggga agtgacatag caggaactac tagtacccct
caggaacaaa taacatggat gacaagtaac ccacctgttc cagtgggaga aatctataaa
agatggataa ttctggggtt aaataaaata gtaaggatgt atagccctgt cagcattttg
gacataaaac aagggccaaa ggaaccctt agagactatg tagaccggtt ctttaaaact
ttaagagctg aacaggctac acaagaagta aaaggctgga tgacagacac cttattggtc
caaaatgcga acccagattg taagaccatt ttaagagcat taggaccagg ggctacacta
gaagaaatga tgacagcatg tcagggagtg ggaggaccta gccacaaggc aagagtgttg
gctgaggcaa tgagccaaac aaacagtgca agcataatga tgcagaaaag caattttaaa
ggagccaaaa gaattgttaa atgcttcaac tgtggcaagg agggcacat agccagaaat
tgcagggccc ctaggaaaaa aggctgttgg aaatgtggac aggaaggaca ccaaatgaaa
gactgtactg agaggcaggc taatttttta gggaaaattt ggccttccca caaggaagg
ccagggaatt ccttcagaa cagaccagag ccaacagcac caccagcaga gagcttcagg
ttcgaggaga caacacccac tccgaagcag gagccgaagg acagggaacc tttaacttcc
ctcaaatcac tctttggcag cgaccctcg tcacaataa
```

FIGURE 84 (SEQ ID NO:87)

```
atgggtgcga gagcgtcaat attaagaggg ggaaaattag ataaatggga aaaaattagg
ttaaggccag ggggaaagaa acattatatg ataaaacacc tagtatgggc aagcagggag
ctggaaagat ttgcacttaa ccctggcctt ttagagacag cagagggctg taaacaaata
ataaaacagc tacatccagc tcttcagaca ggaacagagg aacttagatc attatataac
accgtggcaa ctctttattg cgtacatgca gagatagagg tacgagacac caaggaagcc
ttagacaaga tagaggaaga acaaaacaaa agtcagcaaa aaacacagca ggcaaaagcg
gctgacggaa aagtcagtca aaattatcct atagtacaga atctccaagg gcaaatggta
caccaggcca tatcacctag aaccttgaat gcatgggtaa aagtaataga ggaaaaggct
tttagcccag aggtaatacc catgtttaca gcattatcag aaggagccac cccccaagac
ttaaacacca tgttaaatac agtggggggga catcaagcag ccatgcaaat gttaaaagat
accatcaacg aggaggctgc agaatgggat agattacatc cagcacaggc agggcctgtt
gcaccaggcc aaataagaga accaaggga agtgacatag caggaactac tagtacccttt
caggaacaaa taacatggat gacaagtaac ccacctgttc cagtgggaga aatctataaa
agatggataa ttctgggggtt aaataaaata gtaaggatgt atagccctgt cagcattttg
gacataaaac aagggccaaa ggaaccctt agagactatg tagaccggtt ctttaaaact
ttaagagctg aacaggctac acaagaagta aaaggctgga tgacagacac cttattggtc
caaaatgcga acccagattg taagaccatt ttaagagcat taggaccagg ggctacacta
gaagaaatga tgacagcatg tcagggagtg ggaggaccta gccacaaggc aagagtgttg
gctgaggcaa tgagccaaac aaacagtgca agcataatga tgcagaaaag caatttaaa
ggagccaaaa gaattgttaa atgcttcaac tgtggcaagg aggggcacat agccagaaat
tgcagggccc ctaggaaaaa aggctgttgg aaatgtggac aggaaggaca ccaaatgaaa
gactgtactg agagacaggc taattttta gggaaaattt ggccttccca caaggaagg
ccagggaatt tccttcagaa cagaccagag tcaacagcac caccagcaga gagcttcagg
ttcgaggaga caacacccac tccgaagcag gagccgaagg acagggaacc tttagcttcc
ctcaaatcac tctttggcag cgacccctcg tcacaataa
```

FIGURE 85 (SEQ ID NO:88)

```
atgggtgcga gcgtcaatat taaaaggggg aaaattagat gcatgggaaa gaattaggtt
aaggccaggg ggaaagaaac actatatgat aaaacattta gtatgggcaa gcagggagct
ggaaagattt gcacttaacc ctggcctgtt agagacatca gaaggatgta aacaaataat
gaaccagcta caaccatctc ttcagacagg aacagaagaa cttagatcat tatacaacac
agtagcaact ctctattgtg tacatgaaaa gatagaggta cgagacacca aggaagcctt
agacaagata gaggaagaac aaaacaaaag ccagcaaaaa acacaacagg caaaagcggc
tggcgaaaag gtcagtcaaa attatcctat agtgcagaat gcccaagggc aaatggtaca
ccaagctata tcacctagaa cgttaaatgc atgggtaaaa gtaatagagg agaaggcttt
cagcccagag gtaataccca tgtttacagc attatcagaa ggagccaccc cacaagattt
aaacaccatg ttaaatacag tgggaggaca tcaagcagcc atgcaaatgt taaaagatac
catcaatgag gaagctgcag aatgggatag ggtacatcca gtgcatgcag ggcctgttgc
accaggacag atgagagaac caaggggaag tgacatagca ggaactacta gtaccctgca
ggaacaaata gcatggatga caagtaatcc acctattcca gtaggagaaa tttataaaag
atggataatt ctggggttaa ataaaatagt aagaatgtat agccctgtca gcatcttgga
cataaaacaa gggccaaagg aaccctttag ggactatgta gaccggttct ttaaaacttt
aagagccgaa caggctacac aagatgtaaa aaattggatg acagacacct tgttggtcca
aaatgcgaac ccagattgta agaccatttt aagagcatta ggaccagggg cttcattaga
agaaatgatg acagcatgtc agggagtggg aggacctagc cacaaagcaa gagtgttggc
tgaggcaatg agccaagcaa acaatataaa catactgatg cagagaagca attttaaggg
ctctaagaga attgttaaat gcttcaactg tggcaaggaa gggcacatag ccagaaattg
cagggcccct aggaaaaagg gctgttggaa atgtggaaag gaaggacacc aaatgaaaga
ctgtactgag aggcaggcta ttttttagg gaaaatttgg ccttcccgca aggggaggcc
agggaatttc cttcagaaca ggccagagcc aacagcccca ccagcagaaa gcttcaggtt
cgaggagaca acccctgcgc cgaagcagga caaggaaccc ttaacttccc tcaaatcact
ctttggcagc gacccctcgt cacaataa
```

FIGURE 86 (SEQ ID NO:89)

```
atgggtgcga gagcgtcaac attaaaaggg ggaaaattag atgcatggga aagaattagg
ttaaggccag ggggaaagaa acactatatg ataaaacatt tagtatgggc aagcagggag
ctggaaagat ttgcacttaa ccctggcctg ttagagacat cagaaggatg taaacaaata
atgaaccagc tacaaccatc tcttcagaca ggaacagaag aacttagatc attatacaac
acagtagcaa ctctctattg tgtacatgaa aagatagagg tacgagacac caaggaagcc
ttagacaaga tagaggaaga acaaaacaaa agccagcaaa aaacacaaca ggcaaaggcg
gctggcgaaa aggtcagtca aaattatcct atagtgcaga atgcccaagg gcaaatggta
caccaagcta tatcgcctag aacgttaaat gcatgggtaa aagtaataga ggagaaggct
ttcagcccag aggtaatacc catgtttaca gcattatcag aaggagccac cccacaagat
ttaaacacca tgttaaatac agtgggagga catcaagcag ctatgcaaat gttaaaagat
accatcaatg aggaagctgc agaatgggat agggtacatc cagtgcatgc aaggcctgtt
gcaccaggac agatgagaga accaagggga agtgacatag caggaactac tagtaccctg
caggaacaaa tagcatggat gacaagtaat ccacctattc cagtaggaga aatttataaa
agatggataa ttctggggtt aaataaaata gtaagaatgt atagccctgt cagcatcttg
gacataaaac aagggccaaa ggaacccttt agggactatg tagaccggtt ctttaaaact
ttaagagctg aacaagctac acaagatgta aaaaattgga tgacagacac cttgttggtc
caaaatgcga acccagattg taagaccatt ttaagagcat tagggccagg ggcttcatta
gaagaaatga taacagcatg tcagggagtg ggaggaccta gccacaaagc aagagtgttg
gctgaggcaa tgagccaagc aaacaatata aacatactga tgcagagaag caatttttaag
ggctctaaga gaattgttaa atgcttcaac tgtggcaagg aagggcacat agccaaaaat
tgcagagccc ctaggaaaaa gggctgttga aaatgtagaa aagaaagaca ccaaatgaaa
gactgtactg aaaggcaggc taattttttta gggaaaattt ggccttccca caaggggagg
ccaggaatt tccttcagaa caggccagag ccaacagccc caccagcaga aagcttcagg
ttcgagaaga caacccctgc gccgaagcag gacaaggaac ccttaacttc cctcaaatca
ctctttggca gcgacccctc gtcacaataa
```

FIGURE 87 (SEQ ID NO:90)

```
atgggtgcga gagcgtcaat attaagaggg ggaaaattag ataaatggga agaaattagg
ttaaggccag ggggaaagaa aacctatagg ctaaaacatc tagtatgggc aagcagggag
ctggaaagat ttgcacttaa ccctggcctt ttagagacag cagaaggctg taaacaaata
ataagacagc tacacccagc tcttcagaca ggaacggagg aacttagatc attatacaac
acagtagcaa ctctctattg tgtacatgca aacatagagg taaaagacac caaggaagcc
ttagacaaga tagaggaaga acaaaacaaa agtcagcaaa aatcagagca ggcaaaagta
ggtaacgaaa agatcagtca aaattatcct atagtgcaga atctccaagg gcaaatggta
caccaggcct tatcacctag aactttgaat gcatgggtaa aagtaataga ggagaaggct
ttcagcccag aggtaatacc catgtttaca gcattatcag aaggagccac cccacaagat
ttaaacacca tgttaaacac agtgggggggg catcaagcag ccatgcaaat gttaaaagac
accatcaatg aagaggctgc agaatgggat cgattacacc cagtacatgc agggcctatt
gcaccaggcc aaatgagaga accaagggga agtgacatag caggaactac tagcacccct
caggaacaaa tagcatggat gacaagtaac ccacctattc cggtgggaga tatctataaa
agatggataa ttctggggtt aaataaaata gtaagaatgt atagccctgt cagcattttg
gacattaaac aagggccaaa ggaacccttt agagactatg tagaccggtt ctttaaaact
ttaagagctg aacaagctac acaagatgta aaaaattgga tgacagacac cttgttggtc
caaaatgcga acccagattg taagatcatt ttaagaggat taggaccagg ggctacatta
gaagaaatga tgacagcatg tcagggagtg ggaggaccta gccacaaagc aagagtgttg
gctgaggcaa tgagccaagc aaacagtgga aacataatga tgcagaaaag caattttaga
ggctctaaaa gaattattaa atgttttaac tgtggcaagg aagggcacat agccaaaaat
tgtaaggccc ctaggaaaag aggctgttgg aaatgtggaa aggaaggaca ccaaatgaaa
gactgtactg aaagacaggc taattttta gggaaaattt ggccttcctg caaggggagg
ccagggaatt tccttcagaa caggccagag ccaacagccc caccagcaga gccaacagcc
ccaccagcag agagcctcag gatcgaggaa acaaccccg ctccgaagcc ggagccgagg
gacagggaac ccttaatctc cctcaaatca ccctttggca gcgacccctc gtcacaataa
```

FIGURE 88 (SEQ ID NO:91)

```
atgggtgcga gagcgtcagt attaagaggc gaaaaattag atacatggga aaaaattagg
ttaaggccag ggggaaagaa acgctatatg ctaaaacaca tagtatgggc aagcagggag
ctggaaagat ttgcacttaa ccctggcctt ttagagacat cagaaggctg taaacaaata
atacaacagc tacaaccagc tcttcagaca ggaacagagg aacttaaatc gttattcaac
acagtagcaa ctctctattg tgtacataaa aagatagagg ttcgagacac caaggaagcc
ttagacaaga tagaggaaga acaaaacaaa agtcagcaaa aaacacagca ggcagaagcg
gctgacaaaa aggtcagtca aaattatcct atagtacaga acctccaagg gcaaatggta
caccaagccc tatcacctag aactttgaat gcatgggtaa aagtaataga ggagaaggct
tttggcccag aggtaatacc catgtttaca gcattatcag aaggagccac cccagcagat
ttaaacacca tgttaaatac agtggggga catcaggcag ccatgcagat gttaaaagat
accatcaatg aggaggctgc agaatgggac agattacacc cagtacatgc agggcctact
gcaccaggcc aaatgagaga acctagggga agtgacatag caggaactac tagtaccctt
caggaacaaa tagctcggat gacaagtaac ccacctgtcc cagtgggaga catctataaa
agatggataa ttctagggtt aaataaaata gtaagaatgt atagccctgt cagcattttg
gacataaaac aggggccaaa agaacccttt agagactatg tagaccggtt ctttaaaact
ttaagagctg aacaagctac acaagaggta aaaggttgga tgacagacac cttgttggtc
caaaatgcga acccagattg taagaccatt ttaagagcat taggaccagg ggctacatta
gaagaaatga tgacagcatg tcagggagtg ggaggacctg gccacaaagc cagagtgttg
gctgaggcaa tgagccaagc aaacagtaac atacttatgc agagaagcaa ttttaaaggc
tctaaaagaa ttgttaaatg tttcaactgt ggcaaggaag ggcacatagc cggaaattgc
agggccccta gaaaaaaggg ctgttggaaa tgtggaaaag aaggacacca aatgaaagaa
tgtactgaaa ggcaggctaa ttttttaggg aaaatttggc cttcccacaa ggggaggcca
gggaatttcc tccagagcag accagagcca acagccccac cagcagagag cttcaggttc
gaggagacaa ccccgctcc gaagcaggag tcgaaagaca gggagccctt aacttccctc
agatcactct ttggcaacga ccctcgtca caataa
```

FIGURE 89 (SEQ ID NO:92)

```
atgggtgcga gagcgtcagt attaagaggc gaaaaattgg atacatggga aaagattagg
ttaaggccag ggggaaagaa acgctatatg ctaaaacaca tagtatgggc aagcagggag
ctggaaagat ttgcacttaa ccctggcctt ttagagacat cagaaggctg taaacaaata
atacaacagc tacaaccagc tcttcagaca ggaacagagg aacttaaatc attattcaac
acagtagcaa ctctctattg tgtacacaga aagatagagg tacgagacac caaagaagcc
ttagacaaga tagaggaaga acgaaacaaa agtcagcaaa aaacacagca ggcagaagcg
gctgacaaaa aggtcagtca aaattatcct atagtacaga atctccaagg gcaaatggta
caccaggccc tatcacctag aactttgaat gcatgggtaa aagtaataga ggagaaggct
tttagcccag aggtaatacc catgtttaca gcattatcag aaggagccac cccagcagat
ttaaacacca tgttaaatac agtggggggga catcaagcag ccatgcagat gttaaaagat
accatcaatg aggaggctgc agaatgggac agattacacc cagtacatgc agggcctgct
gcaccaggcc aaatgagaga acctagggga agtgacatag caggaactac tagtacccttt
caggaacaaa tagcatggat gacaagtaac ccacctgtcc cagtgggaga catctataaa
agatggataa ttctagggtt aaataaaata gtaagaatgt atagccctgt cagcattttg
gacataaaac aggggccaaa agaacccttt agagactatg tagaccggtt ctttaaaact
ttaagagctg aacaagctac acaagaggta aaaggttgga tgacagacac cttgttggtc
caaaatgcga acccagattg taagaccatt ttaagagcat taggaccagg ggctacatta
gaagaaatga tgacagcatg tcagggagtg ggaggacctg gccacaaagc cagagtattg
gctgaggcaa tgagccaagc aaacagtaac atatttatgc agagaagcaa ttttaaaggc
tctaaaagaa ttgttaaatg tttcaactgt ggcaaggaag ggcacatagc caaaaattgc
agggccccta gaaaaaaggg ctgttggaaa tgtggaaaag aaggacacca aatgaaagac
tgtactgaaa ggcaggctaa ttttttaggg aaaatttggc cttcccacaa ggggaggcca
gggaatttcc tccagagcag accagagcca acagccccac cagcagagaa cttcaggttc
gaggagacaa ccccgctcc gaagcaggag tcgaaagaca gggagccctt aacttccctc
agatcactct ttggcaacga ccctcgtca caataa
```

FIGURE 90 (SEQ ID NO:93)

```
atgggtgcga gagcgtcaat attaagaggc ggaaaattag ataaatggga aaaaattaga
ttaaggccag ggggaaagaa acactatatg ttaaaacaca tagtatgggc aagcagggag
ctggaaagat ttgcacttaa ccctggcctt ttagagacat cagaaggctg taaacaaata
atacaacagc tacacacagc tcttaagaca ggaacagagg aacttacatc attatacaac
acagtagcaa ctctctactg tgtacatgca gggatagagg tacgagacac caaggaggcc
ttagacaaga tagaggagga gcaaaacaaa agtcagaaaa aaatgcagca agcagaagtg
gctgacaaaa agaaggtcag tcaaaattat cctatagtac agaatcacca agggcaaatg
gtacaccaga acatatcacc aagaacttta aatgcatggg taaaagtaat agaggagaag
ggtttcaacc cagaggtaat acccatgttt acagcattat cagagggagc cacccctttct
gatctgaaca ccatgttaaa tatagtgggg ggacatcaag cagccatgca aatgttaaaa
gataccatca atgaggaggc tgcagaatgg gatagattac acccagcaca ggcagggcct
gttgcaccag gccaaatcag agatccaagg ggaagtgaca tagcaggaac tactagtacc
cttcaggaac aagtaacatg gatgacaaat aacccaccta ttccagtagg agacatctat
aaaagatgga taattctggg attaaataaa atagtaagaa tgtatagccc tgtcagcatt
ttggacatta gacaaggacc aaaggagcct tttagagact atgtagatcg gttctttaaa
actttaagag ctgaacaagc tacacaagat gtaaaaaatt ggatgacaga caccttgttg
gtccaaaatg caaacccaga ttgtaagacc attttaagag cattaggacc aggggctaca
ttagaagaaa tgatgacagc atgtcaagga gtgggaggac ctagccacaa agcaagagtc
ttggctgagg caatgagcca agcaggcaat acaaacataa tgatgcagaa aagcaatttc
aaaggcccta gaagaactat taaatgcttc aactgtggca aggaaggaca cctagccaga
aattgcaggg cccctaggaa aaaaggctgt tggaaatgtg gaaaggaagg acaccaaatg
aaagactgta ctgagaggca ggctaatttt ttagggaaaa tttggccttc ccactcgggg
aggccaggga acttccttca gaacagacca gagccaacag ccccaccagc agagagcttc
aggttcgagg agacaaccccc cgctcagaag caggagccgc aagacaggga acccttaact
tccctcaaat cactctttgg cggcgacccc tcgtcacaat aa
```

FIGURE 91 (SEQ ID NO:94)

```
atgggtgcga gagcgtcaat attaagaggg ggaaaattag ataaatggga aaaaattagg
ttaaggccag gggggaaaaa acactatatg ctaaaacacc tagtatgggc aagcagagag
ctggaaagat ttgcagttaa ccctggcctt ttagagacat cagacggatg tagacaaata
ataaaacagc tacaaccagc tcttcagaca ggaacagagg aaattagatc attatttaac
acagtagcaa ctctctattg tgtacatgaa gggatagatg tacgagacac caaggaagcc
ttagacaagt tggaggagga acaaaacaaa tgtcagcaaa aaacacagca ggcagaagcg
gctgacaaaa aggtcagtca aaattatcct atagtgcaga acctccaagg gcaaatggta
caccaggcca tatcacctag aaccttgaat gcatgggtaa aagtaataga ggagaaggct
tttagcccag aggtaatacc catgtttaca gcattatcag aaggagccac cccacaagat
ttaaacacca tgttaaatac agtgggggga catcaagcag ccatgcaaat gttaaaagat
accatcaatg aggaggctgc cgaatgggat aggttacatc cagtacatgc agggcctgtt
gcaccaggcc agatgagaga accaagggga agtgacatag cagaaactac tagtacccett
caagaacaaa tagcatggat gacaagtaac ccacctatcc cagtaggaga catctataaa
aggtggataa ttctggggtt aaataaaata gtaagaatgt acagccctgt cagcattttg
gacataaaac aaggaccaaa ggaacccttt agagactatg tagaccggtt cttcaaaact
ttaagagctg aacaatctac acaagaggta aaaaattgga tgacagacac cttgttagtc
caaaatgcga acccagattg taagaccatt ttaagagcat taggaccagg ggcttcatta
gaagaaatga tgacagcatg tcagggagtg ggaggaccta gccacaaagc aagagctttg
gctgaggcaa tgagccaagc aaacaatgca agtgtaatga tgcagaaaag caattttaaa
ggccctagaa gtactgttaa atgtttcaac tgtggcaagg aagggcacat agccaggaat
tgcagggccc ctaggaaaaa ggactgttgg aaatgtggaa aggaaggaca ccaaatgaaa
gactgtactg agagacaggc taatttttta gggaaaattt ggccttccca caggggagg
ccagggaatt tccttcagag caggccagag ccaacagccc caccactaga gccaacagcc
ccaccagcag agagcttcaa gttcgaggag actccgaagc gggagccgaa agacagggaa
cccttaactt ccctcaaatc actctttggc agcgacccct cgtcacaata a
```

FIGURE 92 (SEQ ID NO:95)

```
atgggtgcga gagcgtcaat attaagaggg ggaaaattag acaaatggga aaaaattagg
ttaaggccag gggggaaaaa acgctatatg ctaaaacacc tagtatgggc aagcagagag
ctggacagat ttgcagttaa ccctggcctt ttagagacat cagacggatg tagacaaata
ataaaacagc tacaaccagc tcttcagaca ggaacagagg aaattagatc attatttaac
acagtagcaa ctctctattg tgtacataaa gggatagatg tacgagacac caaggaagcc
ttagacaaga tagaggagga acaaaacaaa tgccagcaaa aaacacagca ggcggaagcg
gctgacaaaa aggtcagtca aaattatcct atagtgcaga acctccaagg gcaaatggta
caccaggcca tatcacctag aaccttgaat gcatgggtaa aagtaataga ggagaaggct
tttagcccag aggtaatacc catgtttaca gcattatcag aaggagccac cccacaagat
ttaaacacca tgttaaatac agtggggga catcaagcag ccatgcaaat gttaaaagat
accatcaatg aggaggctgc cgaatgggat aggttacatc cagtacatgc agggcctgtt
gcaccaggcc agatgagaga accaagggga agtgacatag cagaaactac tagtacccett
caagaacaaa tagcatggat gacaagtaac ccacctatcc cagtaggaga catctataaa
aggtggataa ttctggggtt aaataaaata gtaagaatgt acagccctgt cagcattttg
gacataaaac aaggaccaaa agaaccttt agagactatg tagaccggtt cttcaaaact
ttaagagctg aacaatctac acaagaggta aaaaattgga tgacagacac cttgttagtc
caaaatgcga acccagattg taagaccatt ttaagagcat taggaccagg ggcttcatta
gaagaaatga tgacagcatg tcagggagtg ggaggaccta cccacaaagc aagagttttg
gctgaggcaa tgagccaagc aaacaataca agtgtaatga tacagaaaag caattttaaa
ggccctagaa gagctgttaa atgtttcaac tgtggcaagg aagggcacat agccaggaat
tgcagggccc ctaggaaaaa gggctgttgg aaatgtggaa aggaaggaca ccaaatgaaa
gactgtactg agagacaggc taattttta gggaaaattt ggccttccca caagggaagg
ccagggaatt tccttcagag cagaccagag ccaacagccc caccactaga accaacagcc
ccaccagcag agagcttcaa gttcgaggag actccgaagc aggagccgaa agacagggaa
ccctacaggg aacccttaac ttccctcaaa tcactctttg gcagcgaccc ctcgtcacaa
taa
```

FIGURE 93 (SEQ ID NO:96)

```
atgggtgcga gagcgtcaat attaagaggg acgaaattag atgcatggga aaaaattagg
ttaaggccag ggggaaagaa acattatatg ttaaaacacc tagtatgggc aagcagggag
ctggaaagat ttgcacttaa ccctggcctt ttagaaacat cggaaggctg taaacaaata
atgaaacagc tacacccagc tcttcagaca ggaacagagg aacttaaatc attatacaac
acagtagcaa ctctctattg tgtacatgaa agcataaagg tacgagacac caaggaagcc
ttagacaaga tagaggaaga acaaaacaaa attaaaagtc agcaaaaaac acagcaggca
aaagcggctg acgaaaaagt cagtcaaaat tatcctatag tgcagaatct tcaagggcaa
atggtacatc agaacctatc acctagaacc ttgaatgcat gggtaaaagt aatagaggag
aaggctttta gcccagaggt aatacccatg tttacagcat tatcagaagg agccaccca
caagatttaa acaccatgtt aaatacggtg gggggacatc aagcagccat gcaaatgtta
aaagatccca tcaatgaaga ggctgcagaa tgggatagat tacacccagt ccatgcgggg
cctatggcac caggccaatt gagagaacca aggggaagtg acatagcagg aactactagt
acccttcagg aacaaatagc atggatgaca agtaatccac ctatcccagt gggagacatc
tataaaagat ggataattct ggggttaaat aaaatagtga gaatgtatag ccctatcagc
attttggaca taagacaagg gccaaaggaa ccctttagag actatgtaga ccggttcttt
aaagccttaa gagctgaaca agctacacaa gatgtaaaaa attggatgac agaaaccttg
ctggtccaaa atgcgaaccc agattgtaag accattttaa aagcattagg aatagggct
acattggaag aaatgatgac agcatgtcag ggagtggggg gacctagtca caaagcaaga
gtgttagctg aggcaatgag ccaagcaaac aatacaaaca taatgatgca gagaagcaat
tttaaaagct caaaaagaat tgttaaatgt ttcaactgtg gcaaggaagg gcatatagcc
agaaattgca gggcccctag gaaaaagggc tgttggaaat gtggaaagga aggacaccaa
atgaaagatt gtactgagag gcaggcaaat tttttaggga aaatttggcc ttcccacaag
gggaggccag ggaatttcct tcagaacaga ccagagccaa cagccccacc agcagagagt
ttcaggaaca gaccagagcc aacggctcca ccagcagaga gcttcaggtt cgaggagaca
accccactc cgaagcagga gcgaaagac agggatccct taacttccct caaatcactc
tttggcagcg acccctcgtc acaataa
```

FIGURE 94 (SEQ ID NO:97)

```
atgggtgcga gagcgtcaat attaagaggg acgaaattag atgcatggga aaaaattagg
ttaaggccag ggggaaagaa acattatatg ttaaaacacc tagtatgggc aagcagggag
ctggaaagat ttgcacttaa ccctggcctt ttagaaacat cagaaggctg taaacaaata
atgaaacagc tacacccagc tcttcagaca ggaacagagg aacttaaatc attatacaac
acagtagcaa ctctctattg tgtacatgaa aacataaagg tacgagacac caaggaagcc
ttagacaaga tagaggaaga acaaaacaaa attaaaagtc agcaaaaaac acagcaggca
aaagcggctg acgaaaaagt cagtcaaaat tatcctatag tgcagaatct tcaagggcaa
atggtacatc agaacctatc acctagaacc ttgaatgcat gggtaaaagt aatagaggag
aaggctttta gcccagaggt aatacccatg tttacagcat tatcagaagg agccaccccca
caagatttaa gcaccatgtt aaatacggtg gggggacatc aagcagccat gcaaatgtta
aaagatacca tcaatgaaga ggctgcagaa tgggatagat tacacccagt ccatgcgggg
cctatggcac caggccaatt gagagaacca aggggaagtg acatagcagg aactactagt
acccttcggg aacaaatagc atggatgaca agtaatccac ctatcccagt gggagacatc
tataaaagat ggataattct ggggttaaat aaaatagtga gaatgtatag ccctgtcagc
attttggaca taagacaagg gccaaaggaa cccttta gag actatgtaga ccggttcttt
aaagccttaa gagctgaaca agctacacaa gatgtaaaaa attggatgac agaaaccttg
ctggtccaaa atgcgaaccc agattgtaag accattttaa aagcattagg aatagggct
acattggaag aaatgatgac agcatgtcag ggagtgggg gacctagtca caaagcaaga
gtgttagctg aggcaatgag ccaagcaaac aatacaaaca taatgatgca gagaagcaat
tttaaaagct caaaaagaat tgttaaatgt tccaactgtg gcaaggaagg gcatatagcc
agaaattgca gggcccctag gaaaaaggc tgttggaaat gtggaaagga aggacaccaa
atgaaagatt gtactgagag gcaggcaaat tttttaggga aaatttggcc ttcccacaag
gggaggccag ggaatttcct tcagaacaga ccagagccaa cagccccacc agcagagagt
ttcaggaaca gaccagagcc aacggctcca ccagcagaga gcttcaggtt cgaggagaca
accccactc cgaagcagga gccgaaagac agggatccct taacttccct caaatcactc
tttggcagcg accctcgtc acaataa
```

FIGURE 95 (SEQ ID NO:98)

```
atgggtgcga gagcgtcaat attaagaggg gaaaaattag ataaatggga gaaaattagg
ctaaggccag ggggaaggaa acactatatg ctaaaacatc tagtatgggc aagcagagag
ctggaaagat tcgcacttaa ccctggcctt ttagagacat cacaaggctg taaacaaata
ataaaacagc tacacccagc tcttaagaca ggaacagagg aacttaggtc attatacaac
acagtagcaa ctctctattg tgtacatgaa aacatagagg tacgagacac caaggaggcc
ttagacaaga tagaggaaga acaaaacaaa agtcagcaaa aaacacagca ggcaaaagcg
gctgacgaag gagtcagtca aaattatccc atagtgcaga atctccaagg gcaaatggta
caccaggcca tatcacctag aactttgaat gcatgggtga aagtaataga ggagaaggct
tttagcccag aagtaatacc catgtttaca gcattatcag aaggagccac cccacaagat
ttaaacacca tgttaaatac agtaggggga catcaagcag ccatgcagat gttaaagat
accatcaatg aggaggctgc agaatgggat agattacatc cagtccatgc agggcctgct
gcaccaggcc aaatgaggga acctagagga agtgacatag caggaactac tagtaccctt
caggaacaaa tagcatggat gacaggtaac ccacctgtcc cagtgggaga catctataaa
agatggataa ttctggggtt aaataaaata gtaagaatgt atagccctgt cagcattttg
gacataaaac aagggccaaa ggaacccttt agagactatg tagatcggtt ctttaaagtt
ttaagagctg aacaagctac acaagatgta aaaaattgga tgacagacac cttgttgatc
caaaatgcga acccagattg taagaccatc ttaaaggcat tgggaccagc ggcttcatta
gaagaaatga tgacagcatg tcagggagtg ggaggacctg gccacaaagc aagagtgttg
gctgaggcaa tgagccaagc aaacagtaac ataatgatgc agagaagcaa ttttaaagga
tctaaaagaa ttgttaaatg tttcaactgt ggcaaggaag gcacatagc cagaaattgc
agggccccta gaaaaaaggg ctgttggaaa tgtggacaag aaggacacca aatgaaagac
tgtactgaaa ggcaggctaa tttttaggg aaaatttggc cttcccacaa ggggaggcca
gggaatttcc tccagagcag gccagagcca acagccccac cagcagagag cttcaggttc
gaggaaacaa ccccgctcc gaaacaggag tcgaaggaca gggaaccctt aatttccctc
aaatcactct ttggcagcga cccctcgtca caataa
```

FIGURE 96 (SEQ ID NO:99)

```
atgggtgcga gagcgtcaat attaaaaggc gaaaaattag atagatggga aagaattagg
ttaaggccag ggggaaagaa acattatatg ttaaaacaca tagtatgggc aagcagggag
ttggaaaaat ttgcacttaa ccctggcctt ttagaaacag cagaaggctg taatcaaata
atgaaccagc tacaaccagc tcttcagaca ggaacagagg aacttaaatc attattcaac
acagtagcaa ctctctattg tgtacataaa aagatagatg tacgagacac caaggaagcc
ttagataaga tagaggaaga acaaaacaaa agtcagcaaa aaacacagca ggcaaaagcg
gctgacgaaa aggtcagtca aaattatcct atagtacaaa atctccaagg gcaaatggta
catcaagcca tatcacctag aaccttgaat gcatgggtaa aagtaataga ggagaaggcc
tttagcccag aggtaatacc catgtttaca gcattatcag aaggagccac cccacaagat
ttaaacacca tgttaaatac ggtggggga catcaagcag ccatgcaaat gttaaaagat
accatcaatg aggaggctgc agaatgggat agattacatc cagtacatgc ggggcctgtt
gcaccaggcc aaatgagaga accaaggga agtgacatag caggaactac tagtacccttt
caggaacaaa tagcatggat tacagctaac ccacctattc cagtaggaga aatctataaa
agatggataa ttctggggtt aaataaaata gtgagaatgt atagccctgt cagcattttg
gacataagac aaggaccaaa ggaacccttt agagactatg tagatcggtt ctttaaaact
ttaagagctg aacaagctac acaagatgta aaaaattgga tgacagacac cttgttggtc
caaaatgcga acccagattg taagaccatt ttaagagcat taggaccagg ggctacatta
gaagaaatga tgacagcatg tcagggagtg ggaggaccta gccacaaagc aagagttttg
gctgaggcaa tgagccaagc aaacaatgca gtcataatga tgcagaaaag caatttttaaa
ggtcctagaa aaattattag atgtttcaac tgtggtaagg aagggcacat agccagaaac
tgcagggccc ctaggaaaaa aggctgttgg aaatgtggaa aggagggaca ccaaatgaaa
gactgtactg aaaggcaggc taattttta gggaaaattt ggccttccca caggggagg
ccagggaatt tccttcagaa cagaccagag ccaacagccc caccagcaga gagcttcaag
ttcgaggaga caaccccccac tccgaggcag gagtcgaaag acagggaacc cttaacttcc
ctcaaatcac tctttggcag cgacccctcg tcacaataa
```

FIGURE 97 (SEQ ID NO:100)

```
atgggtgcga gagcgtcaat attaagaggc ggaaaattag atacatggga aaaaattagg
ttaaggccag ggggaaagaa acactatatg ctaaaacatc tagtatgggc aagcagggag
ctggaaagat ttgcacttaa ccctggcctt ttagagacat cagaaggctg taaacaaata
ataagacagc tacaaccagc tcttcagaca ggaacagagg aacttaaatc attatataac
acagtagcaa ctctctattg tgtacatgca aagatagagg tacgagacac caaggaagcc
ttagacagga tagaggaaga acagaaaaaa tgtcagcaaa aaacacagca ggcaaaagag
gctgacggga agatcagtca aaattatcct atagtgcaga atcttcaagg gcaaatggta
caccaggcca tatcacctag aactttgaat gcatgggtaa aagtaataga ggagaaggct
tttagcccag aagtaatacc catgtttaca gcattatcag aaggagccac cccacaagat
ttaaacacca tgctaaatac agtgggggga catcaagcag ccatgcaaat gttaaaagat
accatcaatg aggaggctgc agaatgggac agaatacatc cagtacatgc agggcctatt
gcaccaggcc aaatgagaga accaagggga agtgacatag caggaactac tagtaccctt
caggaacaaa tagcatggat gacaagtaac ccacctgttc cagtgggaga aatctataaa
agatggataa ttctgggcct aaataaaata gtaagaatgt atagccctgt cagcattttg
gacataaaac aaggaccaaa ggaacccttt agagattatg tagatcggtt ctttaaaact
ttaagagccg aacaagctac acaagatgta aaaaattgga tgacagacac cttgttggtc
caaaatgcga acccagattg taagatcatt ttaagaggat taggaccagg ggctacatta
gaagaaatga tgacagcatg tcagggagtg ggaggacctg gccacaaagc aagagtgttg
gctgaggcaa tgagccaagc aaacagtaca aatataatga tgcagagagg caattttaaa
ggccctaaaa gaaacattaa atgttttaac tgtggcaagg aagggcacct agccagaaat
tacagggccc ctaggaaaaa aggttgttgg aaatgtggaa aagaaggaca ccaaatgaaa
gactgtacag agagacaggc taatttttta gggaaaattt ggccttccca cagggaagg
ccagggaact tccttcagaa cagaacagag ccaacagccc caccagcaga gagcttcagg
ttcgaggaga caaaccctgc tccgaagcag gagccgaaag acagggaacc cttaacttcc
ctcaaatcac tctttggcag cgacccctcg tcacaataa
```

FIGURE 98 (SEQ ID NO:101)

```
atgggtgcga gagcgtcaat attaggaggc ggaaaattag atacatggga aaaaattagg
ttaaggccag ggggaaagaa acactatatg ctaaaacatc tagtatgggc aagcagggag
ctggaaagat ttgcacttaa ccctggcctt ttagagacat cagaaggctg taaacaaata
ataagacaac tacaaccagc tcttcagaca ggaacagagg aacttaaatc attatacaac
acagtagcaa ctctctattg tgtacatgca aagatagagg tacgagacac caaggaagcc
ttagataaga tagaggaaga acagaaaaaa tgtcagcaaa aaacacagca ggcaaaagag
gctgacggga agatcagtca aaattatcct atagtgcaga atcttcaagg gcaaatggta
caccaggcca tatcacctag aactttgaat gcatgggtaa aagtaataga ggagaaggct
tttagcccag aagtaatacc catgtttaca gcattatcag aaggagccac cccacaagat
ttaaacacca tgctaaatac agtggggga catcaagcag ccatgcaaat gttaaaagat
accatcaatg aggaggctgc agaatgggac agaatacatc cagtacatgc agggcctatt
gcaccaggcc aaatgagaga accaagggga agtgacatag caggaactac tagtacccct
caggaacaaa tagcatggat gacaagtaac ccacctgttc cagtgggaga aatctataaa
agatggataa tcctgggcct aaataaaata gtaagaatgt atagccctgt cagcattttg
gacataaaac aaggaccaaa ggaacccttt agagattatg tagaccggtt ctttaaaact
ttaagagccg aacaagctac acaagatgta aaaaattgga tgacagacac cttgttggtc
caaaatgcga acccagattg taagatcatt ttaagaggat taggaccagg ggctacatta
gaagaaatga tgacagcatg tcagggagtg ggaggacctg gccacaaagc aagagtgttg
gctgaggcaa tgagccaagc aaacagtaca aatataatga tgcagagagg caattttaaa
ggccctaaaa gaaacattaa atgttttaac tgtggcaagg aagggcacct agccagaaat
tgcagggccc ctaggaaaaa gggttgttgg aaatgtggaa aagaaggaca ccaaatgaaa
gactgtacag agagacaggc taattttta gggaaaattt ggccttccca caagggaaga
ccagggaact tccttcagaa ccgaacagag ccaacagccc caccagcaga gagcttcagg
ttcgaggaga caaaccctgc tccgaagcag gagccgaaag acagggaacc cttaacttcc
ctcaaatcac tctttggcag cgaccctcg tcacaataa
```

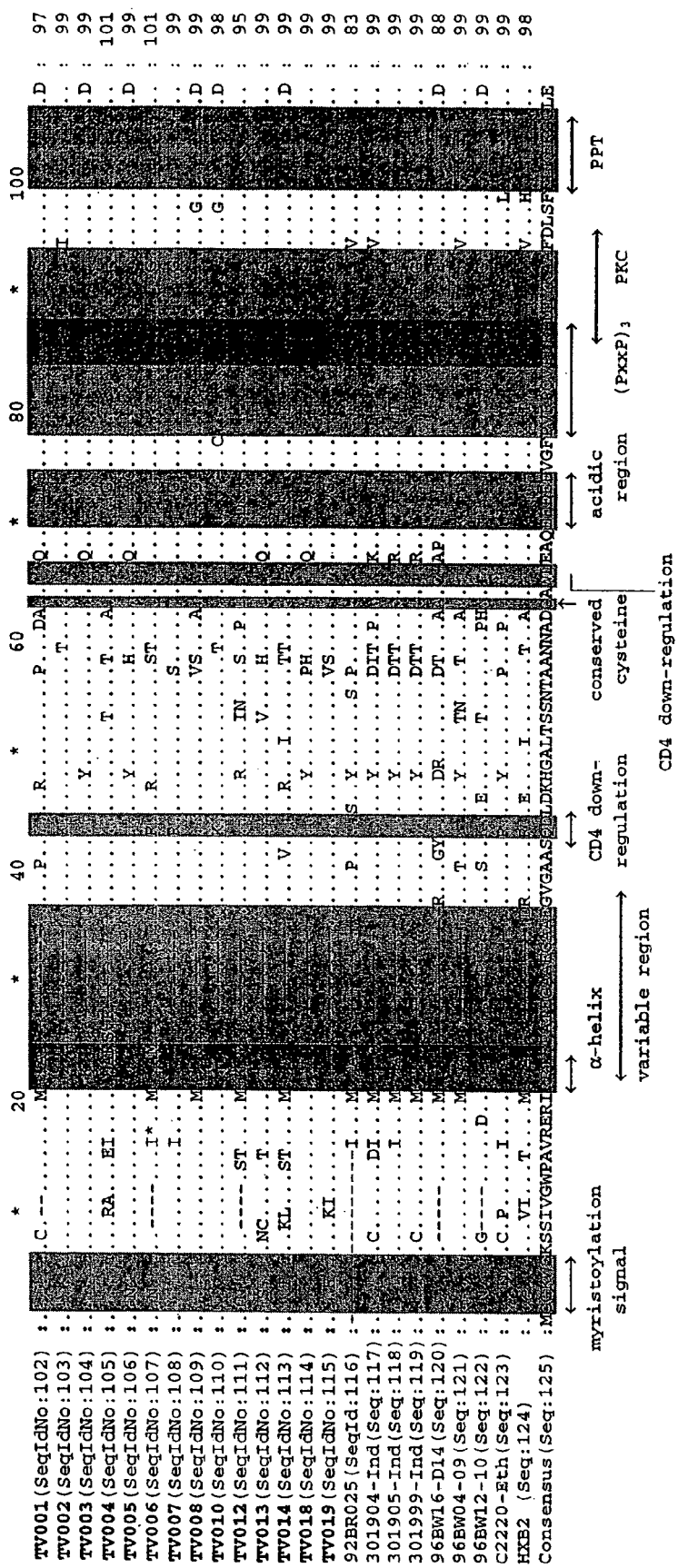
Figure 99a1: Nef

Figure 99a2: Nef (continued)
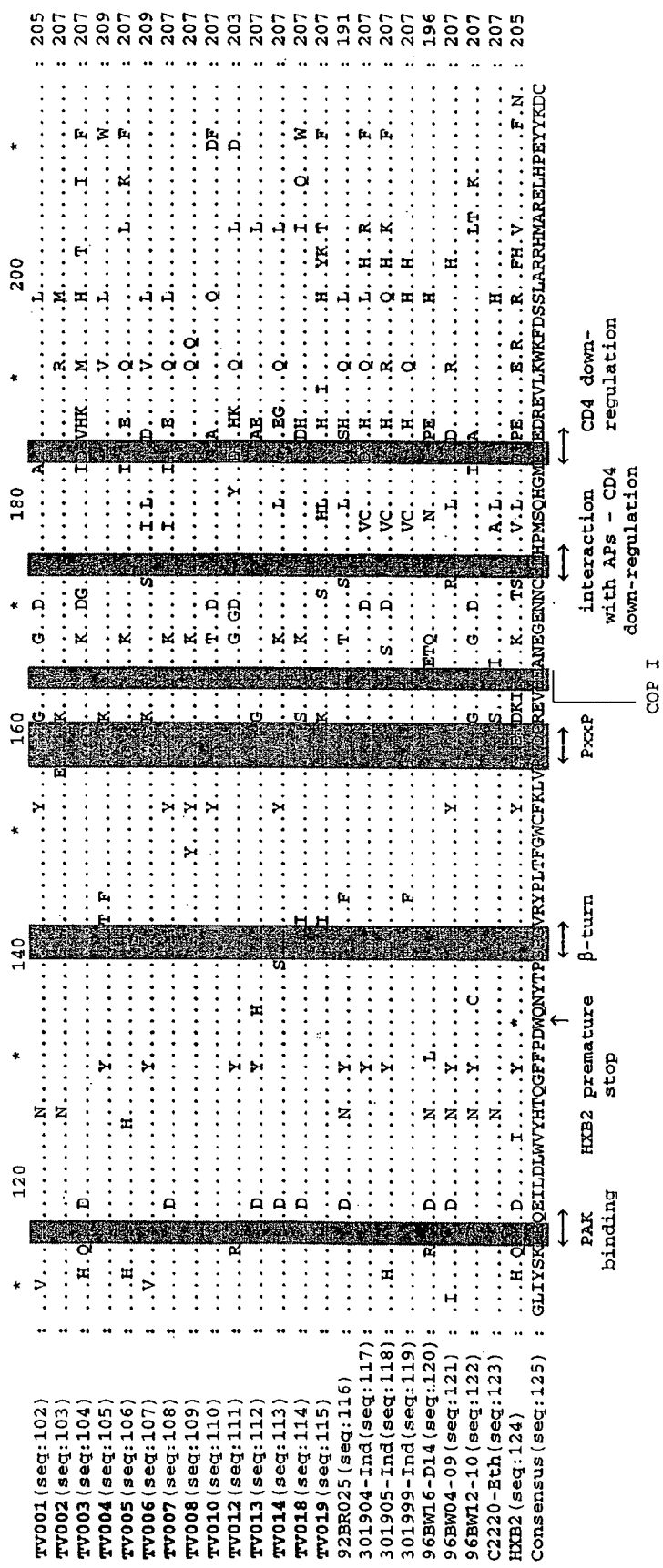

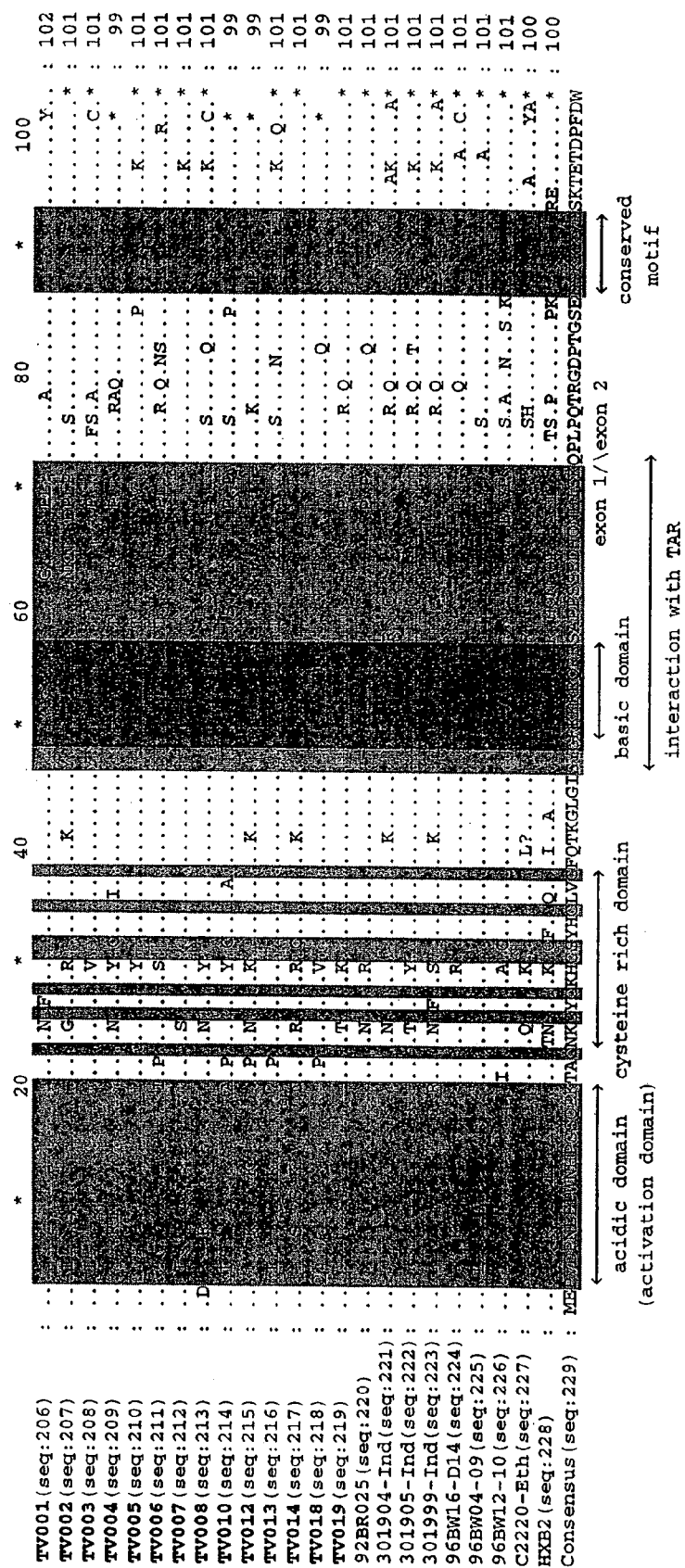
Figure 99b: Tat

Figure 99c: Rev
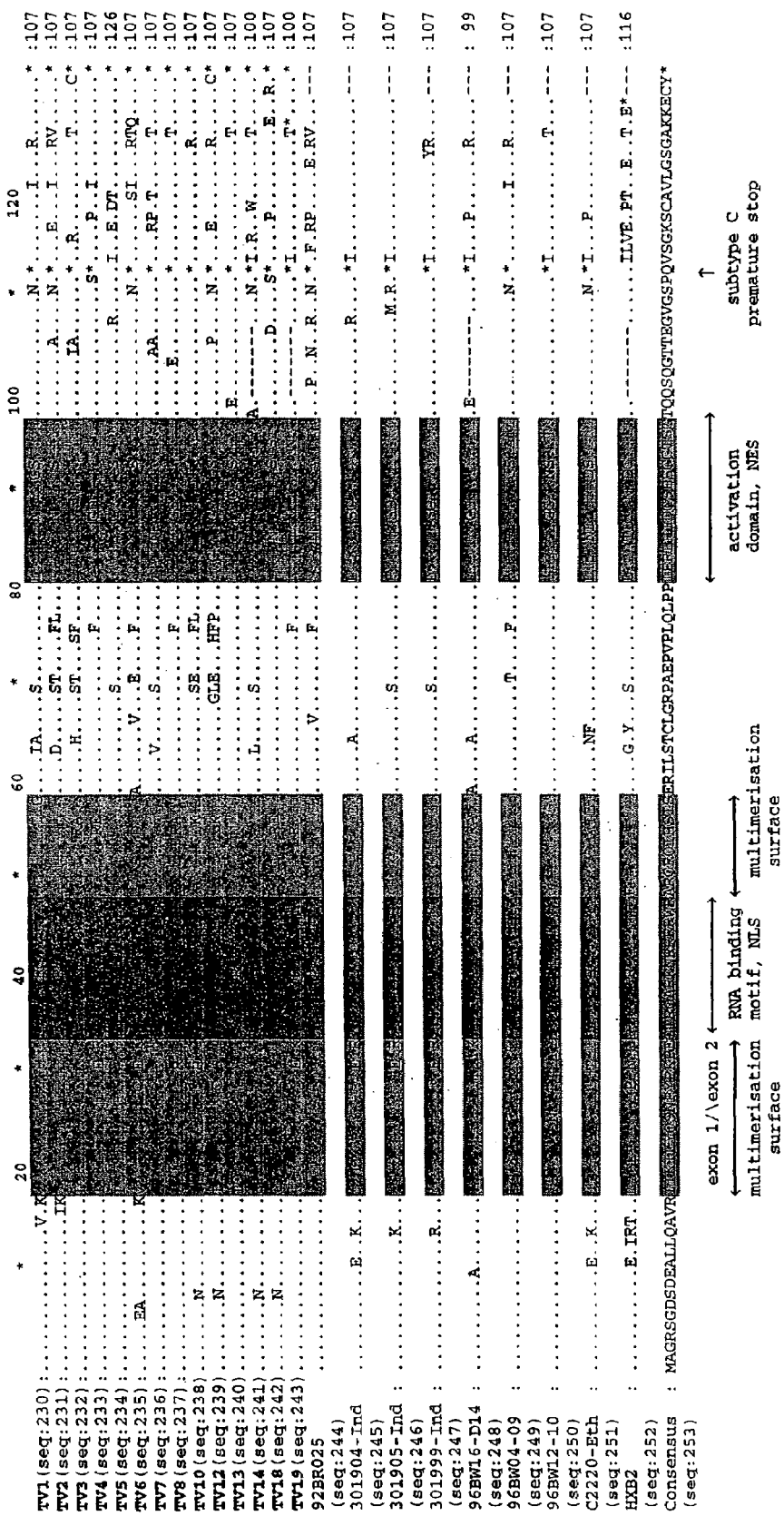

| | | |
|---|---|---|
| IN21068 | : LIGLRIIFAVISIVNRVRQGYSPLSFQTLTPNPGGPDRLGRIEEGGEQDKDRSIRLVSGFLALFWDDLRNLCLFSYHRLRDFILVAARVLELLGRRSLRGLQRG | : 803 |
| 96BW05.02 | : ..L......................P......RE........G.............RG...........................I........Q---- | : 782 |
| ETH2220 | : .V.......................................GR.....N..I..................................L..I...TV...S..K... | : 784 |
| 92BR025.8 | : ..L.....................I.H.R........G..........R.......................A..........L..I...AV........S....I.. | : 789 |
| TV001c8.2 | : ..L.......................S.R.L........G.................R.....................S.A..............S.....I.V..AV..........HS... | : 800 |
| TV001c8.1 | : ..L.......................S.R.L........G.................R.....................S.A..............S.....I.V..AV..........HS... | : 802 |
| TV002c12.1 | : ..L.L....................L..I..R........G................SS..................T.A....S...C..........IVV..AV..........HS... | : 787 |
| TV012c2.1 | : ..L.......................AQ.R..........T.................R................A.E..I.L............V..T..AV...........S.... | : 778 |
| TV012c2.2 | : ..L.......................AQ.R..........T.................R................A.E..I.L............V..T..AV...........S.... | : 778 |
| TV006c9.1 | : S.L.......................A..REL..........................R.....Q..............A.....S..............I..KAA..........HN... | : 784 |
| TV006cE9 | : ..L.......................I..REL..........................R.....R..............A.....S..............I....AA..........HS... | : 790 |
| TV006c9.2 | : ..L.......................I..REL..........................R.....Q..............A.....S...........N..I....AA..........HS... | : 786 |
| TV007cB104 | : ..L................LS.....R............................................S.A..............S.....L..IVV..AV...........S.... | : 792 |
| TV007cB105 | : ..L................LS.....R............................................S.A..............S.....L..IVV..AV...........S.... | : 792 |
| TV010cD7 | : ..A................L..I.D.R......P........................R..................A.....S...C..........I.....V................ | : 779 |
| TV018cF1027 | : ..L..I.................L..R................................R...V...N..........V........A.....V.......Q..L..IV..AV.V...N.........T. | : 792 |
| TV014c6.3 | : ..L......................R................................RE................FS.A................Q....I.T..V............ | : 791 |
| TV014c6.4 | : ..L......................R................................RE................FS.A.....................IVT..V............ | : 791 |
| TV008c4.3 | : ..L.....................I.D.R......R......................R................A......S...........L....GV...V...........S..K. | : 798 |
| TV008c4.4 | : ..L.....................I.D.R......R......................R................A....C..S...........L....GV...V...........S..K. | : 795 |
| TV019c5 | : ..L.L.L..K..............L............RG....................R...R.V...........A......S............Q........IV..AV.I............ | : 795 |
| TV003cE260 | : ..L..V..................I.S.R...............................R...V...N..........IA......S.............I.T..AV...........S.... | : 778 |
| TV004cC300 | : ..L.....................S.....................................R...V...N...........A........S.............T..AV...........S.... | : 788 |
| TV013cH17 | : .LG.L...K...............I...RE......RG.........................................A....S.R............Q......IV..AV.........QS... | : 793 |
| TV013cB20 | : .LG.L...K...............I...RE......RG.........................................A......S............Q......IV..AV.........QS... | : 793 |

FIGURE 100H

```
IN21068      : WEALKYLGSLVQYWGLELKKSAINLLDRIAIAVAEGTDRILELVQRICRAIRNIPRRIRQGFEAALQ : 870
96BW05.02    : ...........................S...T......I.FI...................L... : 849
ETH2220      : ...T.........................NTT.V.G....FI.I...W.FC.............. : 851
92BR025.8    : .......G.....................S.F.T......I.VI.G.W...C............. : 856

TV001c8.2    : ...I.........................S...T..T...I..................L..... : 867
TV001c8.1    : ...I.........................SP..T..T...I..................L..... : 869
TV002c12.1   : .GT..........................T.......................T.L......... : 854
TV012c2.1    : ...I........................VS...SL.....I.FL.G.G..Y.............. : 845
TV012c2.2    : ...I........................VS...SL.....I.FL.G.G..Y.............. : 845
TV006c9.1    : ...I...........A.............S...T.......I..I..W....T............ : 851
TV006cE9     : ...I...........A..........R..S...IT.....I..I..W....T..T.L........ : 857
TV006c9.2    : ...I...........A..........R..S...IT.....I..I..W....T............. : 853
TV007cB104   : .........G...................................................... : 803
TV007cB105   : .........G...................................................... : 803
TV010cD7     : .............................S...T...T..I..I.G.G..Y.............. : 846
TV018cF1027  : ...T....N..L.................R...TT..V..F.AIC......R.............L : 859
TV014c6.3    : ...T.........................S...A......I.FI.......T............. : 857
TV014c6.4    : ...T....G....................R...A....V.I.FI.......T...H.-....... : 858
TV008c4.3    : ................E............S...T...T.G.I.FL.......L......H..... : 865
TV008c4.4    : .............................S...T...T.G.I.FL.......L............ : 862
TV019c5      : .............................S...T......I..ILGLG..C.............. : 862
TV003cE260   : ............................VS...TV..V..I....V......T...T.L...... : 845
TV004cC300   : ............................TS...T..T...I..I...F....LH........L.. : 855
TV013cH17    : ........N....................S...T......V.II..................L.. : 860
TV013cB20    : ........N....................S...T......I.II..................L.. : 860
```

FIGURE 100I

Figure 101
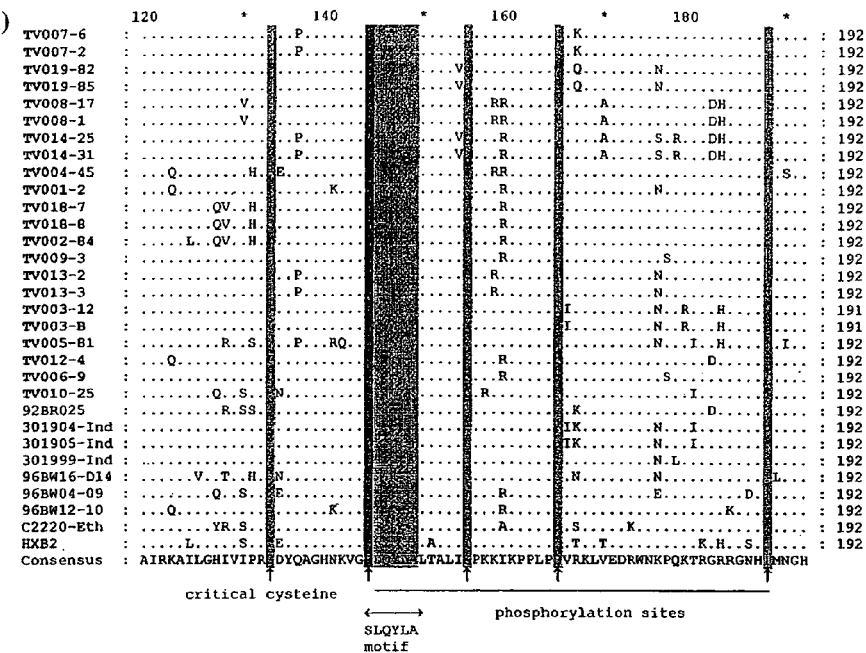
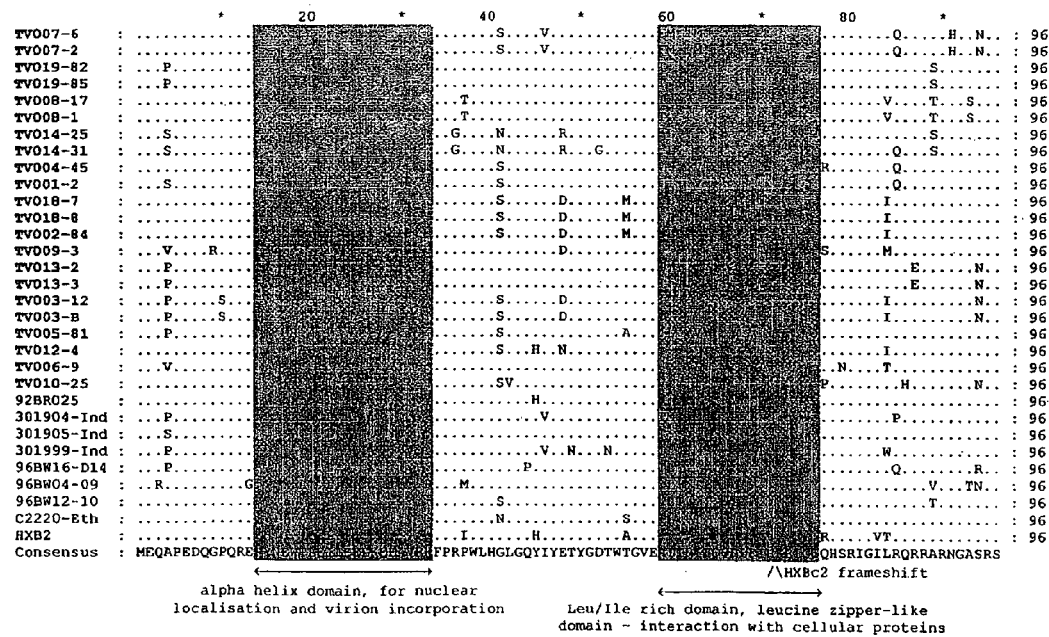

FIGURE 102A (SEQ ID NO:181)

3'half#8_2_TV1_C.ZA

```
GTCGACTGTAGTCCAGGAATATGGCAATTAGATTGTACACATTTAGAAGGAAAAATCATCCT
GGTAGCAGTCCATGTAGCTAGTGGCTACATAGAGGCAGAGGTTATCCCAGCAGAAACAGG
ACAAGAAACAGCATATTTTATATTAAAATTAGCAGGAAGATGGCCAGTCAAGGTAATACATA
CAGACAATGGCAGTAATTTTACCAGTGCTGCAGTTAAGGCAGCCTGTTGGTGGGCAGGTAT
CCAACAGGAATTTGGAATTCCCTACAATCCCCAAAGTCAGGGAGTGGTAGAATCCATGAAT
AAAGAATTAAAGAAAATAATAGGACAAGTAAGAGATCAAGCTGAGCACCTTAGGACAGCAG
TACAAATGGCAGTATTCATTCACAATTTTAAAAGAAAAGGGGGGATTGGGGGGTACAGTGC
AGGGGAAAGAATAATAGACATAATAGCAACAGACATACAAACTAAAGAATTACAAAAACAAA
TTATAAAAATTCAAAATTTTCGGGTTTATTACAGAGACAGCAGAGACCCTATTTGGAAAGGA
CCAGCCAAACTACTCTGGAAAGGTGAAGGGGCAGTAGTAATAGAAGATAAAGGTGACATAA
AGGTAGTACCAAGGAGGAAAGCAAAAATCATTAGAGATTATGGAAAACAGATGGCAGGTGC
TGATTGTGTGGCAGGTGGACAGGATGAAGATTAGAGCATGGAATAGTTTAGTAAAGCACCA
TATGTATATATCAAGGAGAGCTAGTGGATGGTCCTACAAACATCATTTTGAAAGCAGACATC
CAAAAGTAAGTTCAGAAGTACATATCCCATTAGGGGATGCTAGATTAGTAATAAAAACATAT
TGGGGTTTGCAGACAGGAGAAAGAGATTGGCATTTGGGTCATGGAGTCTCCATAGAATGG
AGACTGAGAGAATATAGCACACAAGTAGACCCTGGCCTGGCAGACCAGCTAATTCATATGC
ATTATTTTGATTGTTTACAGAATCTGCCATAAGACAAGCAATATTAGGACACATAGTTATCC
CTAGGTGTGACTATCAAGCAGGACATAAGAAGGTAGGATCTCTACAATACTTGGCACTGAC
AGCATTGATAAAACCAAAAAGGAGAAAGCCACCTCTGCCTAGTGTTAGGAAATTAGTAGAG
GATAGATGGAACGACCCCAGAAGACCAGGGGCCGCAGAGGGAACCATACAATGAATGG
ACACTAGAGATTCTAGAAGAACTCAAGCAGGAAGCTGTCAGACACTTTCCTAGACCATGGC
TCCATAACTTATGAAACCTATGGGGATACTTGGACGGGAGTTGAAGCTATAATAAGAGTAC
TGCAACAACTACTGTTCATTCATTTCAGAATTGGATGCCAACATAGCAGAATAGGCATTTTG
CAACAGAGAAGAGCAAGAAATGGAGCCAGTAGATCCTAAACTAGAGCCCTGGAACCATCC
AGGAAGCCAACCTAAAACTGCTTGTAATAATTGCTTTTGCAAACACTGTAGCTATCATTGTC
TAGTTTGCTTTCAGACAAAAGGCTTAGGCATTTCCTATGGCAGGAAGAAGCGGAGACAGCG
ACGAAGCGCTCCTCCAAGTGGTGAAGATCATCAAAATCCTCTATCAAGCAGTAAGTACTC
ATAGTAGATGTAATGGTAAGTTTAAGTTTAGATAAAGGAATAGATTATAGATTAGGAGTAGG
AGCATTAATAGTAGCACTAATCATAGCAATAATAGTGTGGACCATAGTATATATAGAATATAA
GGAAATTGGTAAGACAAAAGAAAATAGACTGGTTAATTAAAAGAATTAGGGAAAGAGCAGA
AGACAGTGGCAATGAGAGTGATGGGGACACAGAAGAATTGTCAACAATGGTGGATATGGG
GCATCTTAGGCTTCTGGATGCTAATGATTTGTAACACGGAGGACTTGTGGGTCACAGTCTA
CTATGGGGTACCTGTGTGGAGAGACGCAAAAACTACTCTATTCTGTGCATCAGATGCTAAA
GCATATGAGACAGAAGTGCATAATGTCTGGGCTACACATGCCTGTGTACCCACAGACCCCA
ACCCACAAGAAATAGTTTTGGGAAATGTAACAGAAAATTTTAATATGTGGAAAAATGACATG
GCAGATCAGATGCATGAGGATGTAATCAGTTTATGGGATCAAAGCCTAAAGCCATGTGTAA
AGTTGACCCCACTCTGTGTCACTTTAAACTGTACAGATACAAATGTTACAGGTAATAGAACT
GTTACAGGTAATAGTACCAATAATACAAATGGTACAGGTATTTATAACATTGAAGAAATGAA
AAATTGCTCTTTCAATGCAACCACAGAATTAAGAGATAAGAAACATAAAGAGTATGCACTCT
TTTATAGACTTGATATAGTACCACTTAATGAGAATAGTGACAACTTTACATATAGATTAATAA
ATTGCAATACCTCAACCATAACACAAGCCTGTCCAAAGGTCTCTTTTGACCCGATTCCTATA
CATTACTGTGCTCCAGCTGGTTATGCGATTCTAAAGTGTAATAATAAGACATTCAATGGGAC
AGGACCATGTTATAATGTCAGCACAGTACAATGTACACATGGAATTAAGCCAGTGGTATCA
ACTCAATTACTGTTAAATGGTAGTCTAGCAGAAGAAGGGATAATAATTAGATCTGAAAATTT
GACAGAGAATACCAAAACAATAATAGTACACCTTAATGAATCTGTAGAGATTAATTGTACAA
GACCCAACAATAATACAAGAAAAAGTGTAAGGATAGGACCAGGACAAGCATTCTATGCAAC
```

FIGURE 102B

```
AAATGATGTAATAGGAAACATAAGACAAGCACATTGTAACATTAGTACAGATAGATGGAACA
AAACTTTACAACAGGTAATGAAAAAATTAGGAGAGCATTTCCCTAATAAAACAATACAATTTA
AACCACATGCAGGAGGGGATCTAGAAATTACAATGCATAGCTTTAATTGTAGAGGAGAATT
TTTCTATTGTAATACATCAAACCTGTTTAATAGCACATACCACTCTAATAATGGTACATACAA
ATACAATGGTAATTCAAGCTCACCCATCACACTCCAATGTAAAATAAAACAAATTGTACGCA
TGTGGCAAGGGGTAGGACAAGCAACGTATGCCCCTCCCATTGCAGGAAACATAACATGTA
GATCAAACATCACAGGAATACTATTGACACGTGATGGAGGATTTAACACCACAAACAACAC
AGAGACATTCAGACCTGGAGGAGGAGATATGAGGGATAACTGGAGAAGTGAATTATATAAA
TATAAAGTAGTAGAAATTAAGCCATTGGGAATAGCACCCACTAAGGCAAAAAGAAGAGTGG
TGCAGAGAGAAAAAAGAGCAGTGGGAATAGGAGCTGTGTTCCTTGGGTTCTTGGGAGCAG
CAGGAAGCACTATGGGCGCAGCGTCAATAACGCTGACGGTACAGGCCAGACAACTGTTGT
CTGGTATAGTGCAACAGCAAAGCAATTTGCTGAAGGCTATAGAGGCGCAACAGCATATGTT
GCAACTCACAGTCTGGGGCATTAAGCAGCTCCAGGCGAGAGTCCTGGCTATAGAAAGATA
CCTAAAGGATCAACAGCTCCTAGGGATTTGGGGCTGCTCTGGAAGACTCATCTGCACCACT
GCTGTGCCTTGGAACTCCAGTTGGAGTAATAAATCTGAAAAAGATATTTGGGATAACATGA
CTTGGATGCAGTGGGATAGAGAAATTAGTAATTACACAGGCTTAATATACAATTTGCTTGAA
GACTCGCAAAACCAGCAGGAAAAGAATGAAAAAGATTTATTAGAATTGGACAAGTGGAACA
ATCTGTGGAATTGGTTTGACATATCAAACTGGCCGTGGTATATAAAAATATTCATAATGATA
GTAGGAGGCTTGATAGGTTTAAGAATAATTTTTGCTGTGCTTTCTATAGTGAATAGAGTTAG
GCAGGGATACTCACCTTTGTCATTTCAGACCCTTACCCCAAGCCCGAGGGGACTCGACAG
GCTCGGAGGAATCGAAGAAGAAGGTGGAGAGCAAGACAGAGACAGATCCATACGATTGGT
GAGCGGATTCTTGTCGCTTGCCTGGGACGATCTGCGGAACCTGTGCCTCTTCAGCTACCA
CCGCTTGAGAGACTTCATATTAATTGCAGTGAGGGCAGTGGAACTTCTGGGACACAGCAGT
CTCAGGGGACTACAGAGGGGGTGGGAAATCCTTAAGTATCTGGGAAGTCTTGTGCAATATT
GGGGTCTAGAGCTAAAAAAGAGTGCTATTAGTCTGCTTGATACCATAGCAATAACAGTAGC
TGAAGGAACAGATAGGATTATAGAATTAGTACAAAGAATTTGTAGAGCTATCCTCAACATAC
CTAGAAGAATAAGACAGGGCTTTGAAGCAGCTTTGCTATAAAATGGGGGGCAAGTGGTCAA
AATGCAGCGGATGGCCTGCAGTAAGAGAAAGAATGAGACGAGCTGAGCCAGCAGCAGAG
GGAGTAGGACCAGCGTCTCAAGACTTAGATAGACATGGGGCACTTACAAGCAGCAACACA
CCTGCCAATAATGATGCTTGTGCCTGGCTGCAAGCACAGGAGGAGGACGGAGATGTAGGC
TTTCCAGTCAGACCTCAGGTACCTTTAAGACCAATGACTTATAAGAGCGCATTCGATCTCAG
CTTCTTTTTAAAAGAAAAGGGGGGACTGGATGGGTTAGTTTACTCTAAGAAAAGGCAAGAA
ATCCTTGATTTGTGGGTCTATAACACACAAGGCTTCTTCCCTGATTGGCAAAACTACACACC
GGGGCCAGGGGTCAGATATCCACTGACCTTTGGATGGTGCTACAAGCTAGTGCCAGTTGA
CCCAGGGGAGGTGGAAGAGGCCAACGGAGGAGAAGACAACTGTTTGCTACACCCTATGA
GCCAACATGGAGCAGAGGATGAAGATAGAGAAGTATTAAAGTGGAAGTTTGACAGTCTCCT
AGCACGCAGACACATGGCCCGCGAGCTACATCCGGAGTATTACAAAGACTGCTGACACAG
AAGGGACTTTCCGCCTGGGACTTTCCACTGGGGCGTTCCGGGAGGTGTGGTCTGGGCGG
GACTTGGGAGTGGTCAACCCTCAGATGCTGCATATAAGCAGCTGCTTTTCGCTTGTACTGG
GTCTCTCTCGGTAGACCAGATCTGAGCCTGGGAGCTCTCTGGCTATCTAGGGAACCCACT
GCTTAAGCCTCAATAAAGCTTGCCTTGAGTGCTTTAAGTAGTGTGTGCCCGTCTGTTGTGT
GACTCTGGTAACTAGAGATCCCTCAGACCCTTGTGGTAGTGTGGAAAATCTCTAGCAGCG
GCCGC
```

FIGURE 103A (SEQ ID NO:182)
(Sheet 1 of 5)

Full#2_1/4_TV12_C_ZA
TGGAAGGGTTAATTTACTCTAATAAAAGGCAAGAGATCCTTGATTTGTGG
GTTTATAACACACAAGGCTTCTTCCCTGATTGGCAAAACTACACACCGGG
GCCAGGGGTCAGATATCCACTGACCTTTGGATGGTGCTACAAGCTAGAGC
CAGTCGATCCAAAGGAAGTAGAAGAGGCCAATGAAGGAGAAAACAACTG
TTTACTACACCCTATGAGCCAGCATGGGATGGAGGATGAAGACAGAGAAG
TATTAAGATGGAAGTTTGACAGTATGCTAGCACGCAGACACATGGCCCGC
GAGCTACATCCGGAGTATTACAAGGACTGCTGACACAGAAGGGACTTTCC
GCTGGGACTTTCCACTGGGGCGTTCCAGGAGGTGTGGTCTGGGCGGGACT
GGGGAGTGGTCAGCCCTGAGATGCTGCATATAAGCAGCTGCTTTTCGCCT
GTACTGGGTCTCTCTAGGTAGACCAGATCTGAGCCCGGGAGCTCTCTGGCT
ATCTAGGGAACCCACTGCTTAAGCCTCAATAAAGCTTGCCTTGAGTGCCTT
GAGTAGTGTGTGCCCGTCTGTTGTGTGACTCTGGTAACTAGAGATCCCTCA
GACCACTTGTGGTGTGTGGAAAATCTCTAGCAGTGGCGCCTGAACAGGGA
CTTGAAAGCGAAAGTAAGACCAGAGGAGATCTCTCGACGCAGGACTCGG
CTTGCTGAAGTGCACTCGGCAAGAGGCGAGAGAGGCGGCTGGTGAGTAC
GCCAAATTTTATTTGACTAGCGGAGGCTAGAAGGAGAGAGATGGGTGCGA
GAGCGTCAGTATTGAAAGGGAAAAAATTAGATACATGGGAAAGAATTAG
GTTAAGGCCAGGGGGAAAGAAACACTATATGCTAAAACACCTAGTATGG
GCAAGCAGGGAGCTGGAAAGATTTGCACTTAACCCTGGCCTTTTAGAAAC
AGCAGAAGGCTGTAAACAAATAATGCAACAGCTACAATCAGCTCTTCAGA
CAGGAACAGAGGAACTTAGATCATTATATAACACAGTAGCAACTCTCTAT
TGTGTACATAAAGAGATAGATGTACGAGACACCAAGGAAGCCTTAGACA
AGATAGAGGAAGAACAAAATAAGAGTCAGCAAAAAACACAGCAAGCAG
AAGCGGCTGACAAAGGAAAGGTCAGTCAAAATTATCCAATAGTGCAGAA
TCTCCAAGGGCAAATGGTACACCAGGCCATATCACCGAGAACTTTAAATG
CATGGGTAAAAGTAATAGAAGAGAAGGCTTTCAGCCCAGAGGTAATACCC
ATGTTTACAGCATTATCAGAAGGAGCTACCCCACAAGATTTAAACACCAT
GTTAAATACAGTGGGGGGACACCAAGCAGCCATGCAAATGTTAAAAGAT
ACCATCAATGAGGAGGCTGCAGAATGGGATAGGTTACATCCAGTGCATGC
AGGGCCTATTGCACCAGGCCAAATGAGAGAACCAAGGGGAAGTGACATA
GCAGGAACTACTAGTACCCTTCAAGAACAAATAGCATGGATGACAAGTAA
CCCACCTATTCCGGTGGGAGACATCTATAAAAGATGGATAATTCTGGGGT
TAAATAAAATAGTAAGAATGTATAGCCCTGTCAGCATTTTGGACATAAAA
CAAGGGCCAAAAGAACCCTTTAGAGACTATGTAGACCGATTCTTTAAAAC
TTTAAGGGCTGAACAATCTTCACAAGAGGTAAAAAATTGGATGACAGACA
CCTTGTTGGTCCAAAATGCAAACCCAGATTGTAAGACCATTTTAAGAGCA
TTAGGACCAGGGGCTACATTAGAGGAAATGATGACAGCATGTCAGGGAGT
AGGAGGACCTGGCCACAAAGCAAGAGTTTTGGCTGAGGCAATGAGCCAA
GCAAATACAAACATAATGATGCAGAAAAGCAATTTTAAAGGCCCTAAAA
GAACTGTTAAATGTTTCAATTGTGGCAAGGAAGGGCATATAGCCAGAAAT
TGCAGGGCCCCTAGGAAAAAGGGCTGTTGGAAATGTGGAAAGGAAGGAC
ACCAAATGAAAGACTGTACTGAAAGGCAGGCTAATTTTTTAGGGAAAATT
TGGCCTTCCTACAAGGGGAGGCCGGGGAATTTCCTTCAGAGCAGACCAGA
ACCATCAGCCCCACCAGCAGAGAGCTTCAGGTTCGAGGAGCAGGAGCCG
AAAGACAAGGAACCACCCTTAACTTCCCTCAAATCACTCTTTGGCAGCGA
CCCCTTGTCTCAATAAAAGTAGAGGGCCAGATAAAGGAGGCTCTCTTAGA

FIGURE 103B (SEQ ID NO:182)
(Sheet 2 of 5)

TACAGGAGCAGATGATACAGTATTAGAAGAAATAAATTTGCCAGGAAAAT
GGAAACCAAAAATGATAGGAGGAATTGGAGGTTTTATCAAAGTAAGACA
GTATGAGCAAATACTTATAGAAATTTGTGGAAAAAAGGCTATAGGAACAG
TATTAGTAGGACCTACACCTGTCAACATAATTGGAAGAAATATGTTGACT
CAGCTTGGATGCACACTAAATTTTCCAATTAGTCCCATTGAAACTGTACCA
GTAAAATTAAAGCCAGGAATGGATGGCCCAAGAGTTAAACAATGGCCATT
GACAGAAGAAAAATAAAAGCATTAACAGCAATTTGTGAAGAAATGGAG
AAGGAAGGAAAAATTACAAAAATTGGGCCTGAAAATCCATATAACACTCC
AGTATTTGCCATAAAAAGAAGGACAGTACTAAGTGGAGAAAATTAGTA
GATTTCAGGGAACTCAATAAAAGAACTCAAGACTTTTGGGAAGTTCAATT
AGGAATACCACACCCAGCAGGGTTAAAAAAGAAAAAATCAGTGACAGTG
CTGGATGTGGGGGATGCATATTTTTCAGTTCCTTTAGATGAAAGCTTCAGG
AAATATACTGCATTCACCATACCTAGTATAAACAATGAAGCACCAGGGAT
TAGATATCAATATAATGTGCTTCCACAGGGGTGGAAAGGATCACCAGCAA
TATTCCAGTGTAGCATGACAAAAATCTTAGAGCCTTATAGGAAACAAAAT
CCAAACATAGTTATCTATCAATATATGGATGATTTGTATGTAGGATCTGAC
TTAGAAATAGGGCAACATAGAGCAAAAATAGAGGAGTTAAGAGAACATT
TATTGAGGTGGGGACTTACCACACCAGACAAGAAACATCAGAAAGAACC
CCCATTTCTCTGGATGGGGTATGAACTACATCCTGACAAATGGACAGTAC
AGCCTATACTGCTGCCAGAAAAGGATAGCTGGACTGTCAATGATATACAG
AAGTTAGTGGGAAAGTTAAACTGGGCCAGTCAGATTTACCCAGGGATTAA
AGTAAAGTACTTGTGCAAACTCCTTAGGGGAGCCAAAGCACTAACAGACA
TAGTACCACTGACTGAAGAAGCTGAATTAGAATTGGCAGAGAACAGGGA
AATTCTAAAAGAACCAGTACATGGAGTATATTATGACCCCTCAAAAGACT
TAATAGCTGAAATACAGAAACAGGGGCATGACCAATGGACATACCAAATT
TACCAAGAACCATTCAAAAATCTGAAAACAGGGAAGTATGCAAAAATGA
GGACTGCCCACACTAATGATGTAAAACAGTTAACAGAAGCAGTGCAAAA
AATAGCTCTAGAAAGCATAGTAATATGGGGAAAGACTCCTAAATTCAGAC
TACCCATCCAAAAAGAAACATGGGAGACATGGTGGACAGACTATTGGCA
AGCCACCTGGATCCCTGAATGGGAGTTTGTTAATACCCCTCCCCTAGTAAA
ATTATGGTACCAACTGGAAAAAGAACCCATAGCAGGGGTAGAGACTTTCT
ATGTAGATGGAGCAGCTAACAGGGAAACTAAAATAGGAAAAGCAGGGTA
TGTTACTGACAAAGGAAGACAGAAAATTGTTACTCTAAATGAAACAACAA
ATCAGAAGGCTGAGTTACAAGCAATTCAGCTAGCTTTGCAGGATTCAGGA
TCAGAAGCAAACATAGTAACAGACTCACAGTATGCATTAGGAATTATTCA
AGCACAACCAGATAAGAGTGAATCAGAGTTAGTTAACCAGATAATAGAA
CAGTTAATAAACAAGGAGAGAATCTACCTGTCATGGGTACCAGCACATAA
AGGAATTGGAGGAAATGAACAAGTAGACAAATTAGTAAGTAGTGGAATC
AGGAAAGTGCTGTTTCTAGATGGGATAGATAAGGCTCAAGAAGAGCATGA
AAAATATCACAGCAATTGGAGAGCAATGGCTAGTGAGTTTAATCTGCCAC
CCATAGTAGCAAAAGAAATAGTAGCCAGCTGTGATAAATGTCAGCTAAAA
GGGGAAGCCATACATGGACAAGTCGACTGTAGTCCAGGAATATGGCAATT
AGATTGTACACATTTAGAAGGAAAAATCATCCTGGTAGCAGTCCATGTAG
CCAGTGGCTACATAGAAGCAGAGGTTATCCCAGCAGAAACAGGACAAGA
AACAGCATATTATATACTAAAATTAGCAGGAAGATGGCCAGTTAAAATAA
TACATACAGATAATGGCAGTAATTTCACCAGTGCTGCAGTTAAAGCAGCC
TGTTGGTGGGCAGGAATCCAACAGGAATTTGGAATTCCCTACAATCCCCA

FIGURE 103C (SEQ ID NO:182)
(Sheet 3 of 5)

```
AAGTCAGGGAGTAGTAGAATCCATGAATAAAGAATTAAAGAAAATCATA
GGGCAGGTAAGAGATCAAGCTGAGCACCTCAAGACAGCAGTACAAATGG
CAGTATTCATTCACAATTTTAAAAGAAAAGGGGGGATTGGGGGGTACAGT
GCAGGGGAAAGGATAATAGACATAATAGCAACAGACATACAAACTAGAG
AATTACAAAAACAAATTATAAAAATTCAAAATTTTCGGGTTTATTACAGG
GACAGCAGAGACCCTATTTGGAAAGGACCAGCCAAACTACTCTGGAAAG
GTGAAGGGGCAGTAGTAATACAAGATAATAGTGACATAAAGGTAGTACC
AAGGAGGAAAGTAAAAATCATTAAGGACTATGGAAAACAGATGGCAGGT
GCTGATTGTGTGGCAGGTAGACAGGATGAAGATTAGAACATGGAATAGTT
TGGTAAAGCATCACATATATATTTCAAGGAGAGCTAATGGATGGTTTTAC
AGACATCATTATGAAAGCAGACACCCAAAAATAAGTTCAGAAGTACACAT
CCCATTAGGGGATGCTAGATTAGTAATAAAAACATATTGGGGTTTGCATA
CAGGAGAAAGAGATTGGCATTTGGGTCATGGAGTCTCCATAGAATGGAAA
TTGAGAAAATATAGCACACAAGTAGACCCTGGCCTGGCAGACCAGCTAAT
TCATGTGCATTATTTTGATTGTTTTGCAGACTCTGCCATAAGACAAGCCAT
ATTAGGACACATAGTTATTCCTAGGTGTGACTATCAAGCAGGACATAATA
AGGTAGGATCTCTACAATACTTGGCACTGACAGCATTGATAAAACCAAAA
AAGAGAAAGCCACCTTTGCATAGTGTTAGGAAATTAGTAGAGGATAGATG
GAACAAGCCCCAGAAGACCAGGGACCGCAGAGGGAACCATACAATGAAT
GGACACTAGAGCTTTTAGAGGAACTCAAACAGGAAGCTGTCAGACACTTT
CCTAGACCATGGCTCCATAGCTTAGGGCAACATATCTATAACACCTATGG
GGATACTTGGACAGGAGTAGAAGCTATAATAAGAATTCTGCAACAACTAC
TGTTTATTCATTTCAGAATTGGGTGCCAGCATAGCAGAATAGGCATTATGC
GACAGAGAAGAGCAAGAAATGGAACCAGTAGATCCTAAACTTGAGCCCT
GGAAACATCCAGGAAGTCAGCCTAAAACTCCTTGTAATAATTGCTATTGC
AAAAAATGTAGCTATCATTGTCTAGTTTGCTTTCAGAAAAAAGGCTTAGG
CATTTCATATGGCAGGAAGAAGCGGAGACAACGACGAAGCACTCCTCCAA
GCAGTGAGGATCATCAAAATCTTATATCAAAGCAGTAAGTACTAAATGGT
AGATGTAATGTTAAGTTTTCTAGAAAAAGTAGATTATGAAATAGGAGTAG
CAGCATTTATAATAGCACTAATCATAGCAATAGTTGTGTGGATCATAGTAT
ATATAGAATATAGGAAATTGTTAAGACAAAAAAGAATAGACTGGTTAATT
GAAAGAATTAGAGAAAGGGCAGAAGACAGTGGCAATGAGAGTGATGGGG
AGCAGGAGGAATTATCAACAATGGTGGATATGGGGAATCTTAGGCTTTTG
GATGCTAATGGTTGGTAATGTAATGGGGAACTTGTGGGTCACAGTCTATT
ATGGGGTACCTGTGTGGAAAGACGCAAAAGCTACTCTATTTTGTGCATCT
GATGCTAAAGCATATGAGAAGAAGTGCATAATGTCTGGGCTACACATGC
CTGTGTACCCACAGACCCCGACCCACAAGAAATAGTTTTGGAGAATGTAA
CAGAAAATTTTAACATGTGGAAAAATAACATGGTGGACCAGATGCATGAG
GATATAATCAGCTTATGGATCAAAGCCTAAAGCCATGTGTAAAGTTGAC
CCCACTCTGTGTCACTTTAAACTGTAGCAATAATGTTAAAAATGCTACCAA
CAGTATGAAGGAAATGAAAAATTGCACTTTCAATATAACCACAGAACTAA
GAGATAAGAGAAAGCAAGAATATGCACTTTTTTATAAACTTGATATAGTA
CCACTTGAGGAGAATTCCAGTAAGTATAGATTAATAAATTGTAATACCTC
AGCCATAACCCAAGCCTGTCCAAAGGTCTCTTTTGACCCAATTCCTATACA
TTATTGTGCTCCAGCTGGTTATGCGATTCTAAAGTGTAATAATAAGACATT
CAATGGAACAGGACCATGCAATAATGTCAGCACGGTACAATGTACACATG
```

FIGURE 103D (SEQ ID NO:182)
(Sheet 4 of 5)

```
GAATTAAGCCAGTAGTATCAACTCAACTACTGTTAAATGGTAGTCTAGCA
GAAGAAGAAATAGTAATTAGATCTGAAAATATGACAAACAATGCCAAAA
TAATAATAGTACATCTTAATGAATCTGTAGAAATTACGTGTACAAGGCCC
AACAATAATACAAGAAAAGTATGAGGATAGGACCAGGACAAACATTCT
ATGCAACAGGAGACATAATAGGAGATATAAGACAAGCACACTGTAACAT
TAGTGAAAAGCAATGGGATCAGACTTTATACAGGGTAAGTGAAAAATTAA
AAGAACACTTCCCTAATAAAACAATAAAGTTTAACTCATCCTCAGGAGGG
GACTTAGAAATTACAACACATAGCTTTAATTGTGGAGGAGAGTTTTTCTAT
TGCAATACATCTGTACTGTTTAATGGCACATACAGTAATGGCACAAACAG
TACAAATACAACAGTCATCACACTCCCATGCAGAATAAAACAAATTATAA
ACATGTGGCAGGGGGTAGGACGAGCAATGTATGCCCCTCCCATTGCAGGA
AACATAACATGTAGATCAAACATCACAGGACTAATATTGACACGTGATGG
AGGGCAGGGAGAGAATGACACAAATGAGATATTTAGACCTGCAGGAGGA
GATATGAGGGACAATTGGAGAAGTGAATTATACAAATATAAAGTGGTAG
AAATTCAGCCATTAGGAGTAGCACCCACTAAGGCAAAAAGGAGAGTGGT
GGAGAGAGAAAAAGAGCAGCTTTGGGAGCTGTGTTCCTTGGGTTCTTGG
GAGCAGCAGGAAGCACTATGGGCGCGGCATCAATAATGCTGACGGTACA
GGCCAGACAACTGTTGTCTGGTATAGTGCAACAGCAAAGCAATTTGCTGA
GAGCTGTAGAGGCGCAACAGCATATGTTGCAACTCACGGTCTGGGGCATT
AAGTAGCTCCAGACAAGAGTCCTGGCTATAGAAAGATACCTAAAGGATCA
ACAGCTCCTAGGGATTTGGGGCTGCTCTGGAAÅACTCATCTGCACCACTG
CCGTGCCTTGGAACAATAGTTGGAGTAATAAATCTCAAGATTATATTTGG
GGAAACATGACCTGGATGCAATGGGATAAAGAAATTAGCAATTACACAG
AAACAATATACAGGTTGCTTGGGGACGCGCAAAACCAGCAGGAGAAAAA
TGAAAAGGAGTTACTAGAATTGGACAGGTGGGGAAATCTGTGGAACTGGT
TTGACATAACAAAATGGCTGTGGTATATAAAAATATTCATAATGGTAATA
GGAGGCTTGATAGGTTTAAGAATAATTTTTGCTGTGCTTTCTATAGTAAAT
AGAGTTAGGCAGGGATACTCACCTTTGTCATTTCAGACCCTTGCCCAAAAC
CCGAGGGGACCCGACAGGCTCGGAAGAACCGAAGAAGAAGGTGGAGAGC
AAGACAGAGACAGATCCATAAGATTAGTGAGCGGATTCTTAGCACTTGCC
TGGGAGGACCTGAGGAACCTGTGCATTTTCCTCTACCACCGATTGAGAGA
CTTCATATTGGTGACAGCGAGAGCAGTGGAACTTCTGGGACGCAGCAGTC
TCAGGGGACTCCAGAGGGGGTGGGAAATCCTTAAGTACCTGGGAAGTCTT
GTGCAGTATTGGGGTCTAGAGCTAAAAAAGAGTGCTGTTAGTCTGCTTGA
TAGCGTAGCAATAGCAGTAGCTGAGGGAACAGATAGAATTATAGAATTCT
TACAAGGAACTGGTAGAGCTATCTACAACATACCTAGAAGAATAAGACAG
GGCTTTGAAGCAGCTTTGCAGTAAAATGGGAAATAAGTGGTCAAAAAGCT
GGCCTGCTGTAAGAGAAAGAATATGGAAAACTAGGCCAGCAGCAGCAGA
AGCAGCTAGGCCAGCAGCAGCAGAAGGAGTAGGAGCAGCGTCTCAAGAC
TTGGATAAACGTGGGGCGCTTACAATCAACAACACAGCCAACAATAATCC
TGATTGTGCCTGGCTGGAAGCGCAAGAGGATGAGGAAGTAGGCTTTCCAG
TCAGACCTCAGGTACCTTTAAGACCAATGACATATAAGGCAGCATTTGAT
CTCAGCTTCTTTTTAAAAGAAAAGGGGGGACTGGAAGGGTTAATTTACTC
CAGGAAAAGGCAAGAGATCCTTGATTTATGGGTCTATCACACACAAGGCT
ACTTCCCTGATTGGCAAAACTACACACCGGGACCAGGGGTCAGATATCCA
CTGACCTTTGGATGGTGCTTCAAGCTAGTGCCAGTTGACCCAAGGGAAGT
AGAAGAGGCCAACGGAGGAGAAGACAACTGTTTGCTACACCCTATGAGC
```

FIGURE 103E (SEQ ID NO:182)
(Sheet 5 of 5)

CAGTATGGAATGGATGATGAACACAAAGAAGTGCTACAGTGGAAGTTTGA
CAGCAGCCTAGCACGCAGACACCTGGCCCGCGAGCTACATCCGGATTATT
ACAAAGACTGCTGACACAGAAGGGACTTTCCGCCTGGGACTTTCCACTGG
GGCGTTCCAGGGGGAGTGGTCTGGGCGGGACTGGGAGTGGCCAGCCCTCA
GATGCTGCATATAAGCAGCTGCTTTTCGCCTGTACTGGGTCTCTCTAGGTA
GACCAGATCTGAGCCTGGGAGCTCTCTGTCTATCTGGGGAACCCACTGCTT
AAGCCTCAATAAAGCTTGCCTTGAGTGCTCTAAGTAGTGTGTGCCCATCTG
TTGTGTGACTCTGGTAACTCTGGTAACTAGAGATCCCTCAGACCCTTTGTG
GTAGTGTGGAAAATCTCTAGCA

FIGURE 104 (SEQ ID NO:183)

gp140.modTV1.mut1.dV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc ctgatcaact gcaacaccag caccatcacc
 541 caggcctgcc ccaaggtgag cttcgacccc atccccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca caaacggcac ctacaagtac
1141 aacggcaaca gcagcagccc catcaccctg cagtgcaaga tcaagcagat cgtgcgcatg
1201 tggcagggcg tgggccaggc cacctacgcc ccccccatcg ccggcaacat cacctgccgc
1261 agcaacatca ccggcatcct gctgacccgc gacggcggct tcaacaccac caacaacacc
1321 gagaccttcc gccccggcgg cggcgacatg cgcgacaact ggcgcagcga gctgtacaag
1381 tacaaggtgg tggagatcaa gcccctgggc atcgccccca ccaaggccaa gcgccgcgtg
1441 gtgcagcgcg agaagagcgc cgtgggcatc ggcgccgtgt tcctgggctt cctgggcgcc
1501 gccggcagca ccatgggcgc cgccagcatc accctgaccg tgcaggcccg ccagctgctg
1561 agcggcatcg tgcagcagca gagcaacctg ctgaaggcca tcgaggccca gcagcacatg
1621 ctgcagctga ccgtgtgggg catcaagcag ctgcaggccc gcgtgctggc catcgagcgc
1681 tacctgaagg accagcagct gctgggcatc tggggctgca gcggccgcct gatctgcacc
1741 accgccgtgc cctggaacag cagctggagc aacaagagcg agaaggacat ctgggacaac
1801 atgacctgga tgcagtggga ccgcgagatc agcaactaca ccggcctgat ctacaacctg
1861 ctggaggaca gccagaacca gcaggagaag aacgagaagg acctgctgga gctggacaag
1921 tggaacaacc tgtggaactg gttcgacatc agcaactggc cctggtacat ctaa
```

FIGURE 105 (SEQ ID NO:184)

gp140mod.TV1.mut2.dV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc ctgatcaact gcaacaccag caccatcacc
 541 caggcctgcc ccaaggtgag cttcgacccc atccccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca caacggcac ctacaagtac
1141 aacggcaaca gcagcagccc catcacccctg cagtgcaaga tcaagcagat cgtgcgcatg
1201 tggcagggcg tgggccaggc cacctacgcc cccccatcg ccggcaacat cacctgccgc
1261 agcaacatca ccggcatcct gctgacccgc gacggcggct caacaccac caacaacacc
1321 gagaccttcc gccccggcgg cggcgacatg cgcgacaact ggcgcagcga gctgtacaag
1381 tacaaggtgg tggagatcaa gccctgggc atcgcccca ccaaggccaa gcgccgcgtg
1441 gtgcagagcg agaagagcgc cgtgggcatc ggcgccgtgt tcctgggctt cctgggcgcc
1501 gccggcagca ccatgggcgc cgccagcatc accctgaccg tgcaggcccg ccagctgctg
1561 agcggcatcg tgcagcagca gagcaacctg ctgaaggcca tcgaggccca gcagcacatg
1621 ctgcagctga ccgtgtgggg catcaagcag ctgcaggccc gcgtgctggc catcgagcgc
1681 tacctgaagg accagcagct gctgggcatc tggggctgca gcggccgcct gatctgcacc
1741 accgccgtgc cctggaacag cagctggagc aacaagagcg agaaggacat ctgggacaac
1801 atgacctgga tgcagtggga ccgcgagatc agcaactaca ccggcctgat ctacaacctg
1861 ctggaggaca ccagaacca gcaggagaag aacgagaagg acctgctgga gctggacaag
1921 tggaacaacc tgtggaactg gttcgacatc agcaactggc cctggtacat ctaa
```

FIGURE 106 (SEQ ID NO:185)

gp140mod.TV1.mut3.dV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc ctgatcaact gcaacaccag caccatcacc
 541 caggcctgcc caaggtgag cttcgacccc atcccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggccccggc caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc tacagcacca acaacggcac ctacaagtac
1141 aacggcaaca gcagcagccc catcaccctg cagtgcaaga tcaagcagat cgtgcgcatg
1201 tggcagggcg tgggccaggc cacctacgcc ccccccatcg ccggcaacat cacctgccgc
1261 agcaacatca ccggcatcct gctgacccgc gacggcggct caacaccac caacaacacc
1321 gagaccttcc gccccggcgg cggcgacatg cgcgacaact ggcgcagcga gctgtacaag
1381 tacaaggtgg tggagatcaa gcccctgggc atcgcccca ccaaggccaa gcgcagcgtg
1441 gtgcagagcg agaagagcgc cgtgggcatc ggcgccgtgt tcctgggctt cctgggcgcc
1501 gccggcagca ccatgggcgc cgccagcatc accctgaccg tgcaggcccg ccagctgctg
1561 agcggcatcg tgcagcagca gagcaacctg ctgaaggcca tcgaggccca gcagcacatg
1621 ctgcagctga ccgtgtgggg catcaagcag ctgcaggccc gcgtgctggc catcgagcgc
1681 tacctgaagg accagcagct gctgggcatc tggggctgca gcggccgcct gatctgcacc
1741 accgccgtgc cctggaacag cagctggagc aacaagagcg agaaggacat ctgggacaac
1801 atgacctgga tgcagtggga ccgcgagatc agcaactaca ccggcctgat ctacaacctg
1861 ctggaggaca gccagaacca gcaggagaag aacgagaagg acctgctgga gctggacaag
1921 tggaacaacc tgtggaactg gttcgacatc agcaactggc cctggtacat ctaa
```

FIGURE 107 (SEQ ID NO:186)

gp140mod.TV1.mut4.dV2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgaccct gaactgcacc gacaccaacg tgaccggcaa ccgcaccgtg
 421 accggcaaca gcaccaacaa caccaacggc accggcatct acaacatcga ggagatgaag
 481 aactgcagct tcaacgccgg cgccggccgc tgatcaact gcaacaccag caccatcacc
 541 caggcctgcc ccaaggtgag cttcgacccc atcccatcc actactgcgc ccccgccggc
 601 tacgccatcc tgaagtgcaa caacaagacc ttcaacggca ccggcccctg ctacaacgtg
 661 agcaccgtgc agtgcaccca cggcatcaag cccgtggtga gcacccagct gctgctgaac
 721 ggcagcctgg ccgaggaggg catcatcatc cgcagcgaga acctgaccga gaacaccaag
 781 accatcatcg tgcacctgaa cgagagcgtg gagatcaact gcacccgccc caacaacaac
 841 acccgcaaga gcgtgcgcat cggcccccgg caggccttct acgccaccaa cgacgtgatc
 901 ggcaacatcc gccaggccca ctgcaacatc agcaccgacc gctggaacaa gaccctgcag
 961 caggtgatga agaagctggg cgagcacttc cccaacaaga ccatccagtt caagccccac
1021 gccggcggcg acctggagat caccatgcac agcttcaact gccgcggcga gttcttctac
1081 tgcaacacca gcaacctgtt caacagcacc taccacagca caacggcac ctacaagtac
1141 aacggcaaca gcagcagccc catcaccctg cagtgcaaga tcaagcagat cgtgcgcatg
1201 tggcagggcg tgggccaggc cacctacgcc cccccccatcg ccggcaacat cacctgccgc
1261 agcaacatca ccggcatcct gctgacccgc gacggcggct caacaccac caacaacacc
1321 gagaccttcc gccccggcgg cggcgacatg cgcgacaact ggcgcagcga gctgtacaag
1381 tacaaggtgg tggagatcaa gcccctgggc atcgccccca ccaaggccaa gagcagcgtg
1441 gtgcagagcg agaagagcgc cgtgggcatc ggcgccgtgt tcctgggctt cctgggcgcc
1501 gccggcagca ccatgggcgc cgccagcatc accctgaccg tgcaggcccg ccagctgctg
1561 agcggcatcg tgcagcagca gagcaacctg ctgaaggcca tcgaggccca gcagcacatg
1621 ctgcagctga ccgtgtgggg catcaagcag ctgcaggccc gcgtgctggc catcgagcgc
1681 tacctgaagg accagcagct gctgggcatc tggggctgca gcggccgcct gatctgcacc
1741 accgccgtgc cctggaacag cagctggagc aacaagagcg agaaggacat ctgggacaac
1801 atgacctgga tgcagtggga ccgcgagatc agcaactaca ccgcctgat ctacaacctg
1861 ctggaggaca gccagaacca gcaggagaag aacgagaagg acctgctgga gctggacaag
1921 tggaacaacc tgtggaactg gttcgacatc agcaactggc cctggtacat ctaa
```

FIGURE 108 (SEQ ID NO:187)

gp140.mod.TV1.GM161

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caaccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 cagtgcagct tcaacgccac caccgagctg cgcgacaaga agcacaagga gtacgccctg
 541 ttctaccgcc tggacatcgt gcccctgaac gagaacagcg acaacttcac ctaccgcctg
 601 atcaactgca acaccagcac catcacccag gcctgcccca aggtgagctt cgacccatc
 661 cccatccact actgcgcccc cgccggctac gccatcctga gtgcaacaa caagaccttc
 721 aacggcaccg gccctgcta caacgtgagc accgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccaacga cgtgatcggc aacatccgcc aggcccactg caacatcagc
1021 accgaccgct ggaacaagac cctgcagcag gtgatgaaga agctgggcga gcacttcccc
1081 aacaagacca tccagttcaa gcccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagccccat caccctgcag
1261 tgcaagatca gcagatcgt gcgcatgtgg cagggcgtgg gccaggccac ctacgccccc
1321 cccatcgccg gcaacatcac ctgccgcagc aacatcaccg gcatcctgct gacccgcgac
1381 ggcggcttca acaccaccaa caacaccgag accttccgcc ccggcggcgg cgacatgcgc
1441 gacaactggc gcagcgagct gtacaagtac aaggtggtgg agatcaagcc cctgggcatc
1501 gccccacca aggccaagcg ccgcgtggtg cagcgcgaga agcgcgccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtggggcat caagcagctg
1741 caggcccgcg tgctggccat cgagcgctac ctgaaggacc agcagctgct gggcatctgg
1801 ggctgcagcg gccgcctgat ctgcaccacc gccgtgccct ggaacagcag ctggagcaac
1861 aagagcgaga aggacatctg gacaacatg acctggatgc agtgggaccc cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggccct ggtacatcta a
```

FIGURE 109 (SEQ ID NO:188)

gp140mod.TV1.GM161-195-204

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagcccctg cgtgaagctg
 361 accccccctgt gcgtgaccct gaactgcacc gacaccaacg tgaccggcaa ccgcaccgtg
 421 accggcaaca gcaccaacaa caccaacggc accggcatct acaacatcga ggagatgaag
 481 cagtgcagct tcaacgccac caccgagctg cgcgacaaga agcacaagga gtacgccctg
 541 ttctaccgcc tggacatcgt gcccctgaac gagaacagcg accagttcac ctaccgcctg
 601 atcaactgcc agaccagcac catcacccag gcctgcccca aggtgagctt cgaccccatc
 661 cccatccact actgcgcccc cgccggctac gccatcctga gtgcaacaa caagaccttc
 721 aacggcaccg gccccctgcta caacgtgagc accgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccaacga cgtgatcggc aacatccgcc aggcccactg caacatcagc
1021 accgaccgct ggaacaagac cctgcagcag gtgatgaaga agctgggcga gcacttcccc
1081 aacaagacca tccagttcaa gccccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagccccat cacccctgcag
1261 tgcaagatca gcagatcgt gcgcatgtgg cagggcgtgg ccaggccac ctacgccccc
1321 cccatcgccg gcaacatcac ctgccgcagc aacatcaccg gcatcctgct gacccgcgac
1381 ggcggcttca acaccaccaa caacaccgag accttccgcc ccggcggcgg cgacatgcgc
1441 gacaactggc gcagcgagct gtacaagtac aaggtggtgg agatcaagcc cctgggcatc
1501 gcccccacca aggccaagcg ccgcgtggtg cagcgcgaga gcgcgcccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtggggcat caagcagctg
1741 caggcccgcg tgctggccat cgagcgctac ctgaaggacc agcagctgct gggcatctgg
1801 ggctgcagcg gccgcctgat ctgcaccacc gccgtgccct ggaacagcag ctggagcaac
1861 aagagcgaga aggacatctg gacaacatg acctggatgc agtgggaccg cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggcccc tgtacatcta a
```

FIGURE 110 (SEQ ID NO:189)

gp140mod.TV1.GM161-204

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 accccctgt gcgtgaccct gaactgcacc gacaccaacg tgaccggcaa ccgcaccgtg
 421 accggcaaca gcaccaacaa caccaacggc accggcatct acaacatcga ggagatgaag
 481 cagtgcagct tcaacgccac caccgagctg cgcgacaaga agcacaagga gtacgccctg
 541 ttctaccgcc tggacatcgt gcccctgaac gagaacagcg acaacttcac ctaccgcctg
 601 atcaactgcc agaccagcac catcacccag gcctgcccca aggtgagctt cgaccccatc
 661 cccatccact actgcgcccc cgccggctac gccatcctga gtgcaacaa caagaccttc
 721 aacggcaccg gccctgcta caacgtgagc accgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccaacga cgtgatcggc aacatccgcc aggcccactg caacatcagc
1021 accgaccgct ggaacaagac cctgcagcag gtgatgaaga gctgggcgca gcacttcccc
1081 aacaagacca tccagttcaa gccccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagccccat cacccttgcag
1261 tgcaagatca agcagatcgt gcgcatgtgg caggggcgtgg gccaggccac ctacgccccc
1321 cccatcgccg gcaacatcac ctgccgcagc aacatcaccg gcatcctgct gacccgcgac
1381 ggcggcttca acaccaccaa caccaccgag accttccgcc ccggcggcgg cgacatgcgc
1441 gacaactggc gcagcgagct gtacaagtac aaggtggtgg agatcaagcc cctgggcatc
1501 gcccccacca aggccaagcg ccgcgtggtg cagcgcgaga gcgcgccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtggggcat caagcagctg
1741 caggcccgcg tgctggccat cgagcgctac ctgaaggacc agcagctgct gggcatctgg
1801 ggctgcagcg gccgcctgat ctgcaccacc gccgtgccct ggaacagcag ctggagcaac
1861 aagagcgaga aggacatctg gacaacatg acctggatgc agtgggaccg cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggccct ggtacatcta a
```

FIGURE 111 (SEQ ID NO:190)

gp140mod.TV1.GM-V1V2

```
   1 atgcgcgtga tgggcaccca gaagaactgc cagcagtggt ggatctgggg catcctgggc
  61 ttctggatgc tgatgatctg caacaccgag gacctgtggg tgaccgtgta ctacggcgtg
 121 cccgtgtggc gcgacgccaa gaccaccctg ttctgcgcca gcgacgccaa ggcctacgag
 181 accgaggtgc acaacgtgtg ggccacccac gcctgcgtgc ccaccgaccc caacccccag
 241 gagatcgtgc tgggcaacgt gaccgagaac ttcaacatgt ggaagaacga catggccgac
 301 cagatgcacg aggacgtgat cagcctgtgg gaccagagcc tgaagccctg cgtgaagctg
 361 acccccctgt gcgtgaccct gcagtgcacc gacacccagg tgaccggcca gcgcaccgtg
 421 accggccaga gcacccagaa cacccagggc accggcatct acaacatcga ggagatgaag
 481 cagtgcagct tccaggccac caccgagctg cgcgacaaga gcacaagga gtacgccctg
 541 ttctaccgcc tggacatcgt gcccctgaac gagaacagcg accagttcac ctaccgcctg
 601 atcaactgcc agaccagcac catcacccag gcctgcccca aggtgagctt cgacccgatc
 661 cccatccact actgcgcccc cgccggctac gccatcctga gtgcaacaa caagaccttc
 721 aacggcaccg gcccctgcta caacgtgagc accgtgcagt gcacccacgg catcaagccc
 781 gtggtgagca cccagctgct gctgaacggc agcctggccg aggagggcat catcatccgc
 841 agcgagaacc tgaccgagaa caccaagacc atcatcgtgc acctgaacga gagcgtggag
 901 atcaactgca cccgccccaa caacaacacc cgcaagagcg tgcgcatcgg ccccggccag
 961 gccttctacg ccaccaacga cgtgatcggc aacatccgcc aggcccactg caacatcagc
1021 accgaccgct ggaacaagac cctgcagcag gtgatgaaga gctgggcga gcacttcccc
1081 aacaagacca tccagttcaa gcccccacgcc ggcggcgacc tggagatcac catgcacagc
1141 ttcaactgcc gcggcgagtt cttctactgc aacaccagca acctgttcaa cagcacctac
1201 cacagcaaca acggcaccta caagtacaac ggcaacagca gcagccccat caccctgcag
1261 tgcaagatca gcagatcgt gcgcatgtgg cagggcgtgg gccaggccac ctacgccccc
1321 cccatcgccg gcaacatcac ctgccgcagc aacatcaccg gcatcctgct gacccgcgac
1381 ggcggcttca acaccaccaa caacaccgag accttccgcc ccggcggcgg cgacatgcgc
1441 gacaactggc gcagcgagct gtacaagtac aaggtggtgg agatcaagcc cctgggcatc
1501 gcccccacca aggccaagcg ccgcgtggtg cagcgcgaga gcgcgccgt gggcatcggc
1561 gccgtgttcc tgggcttcct gggcgccgcc ggcagcacca tgggcgccgc cagcatcacc
1621 ctgaccgtgc aggcccgcca gctgctgagc ggcatcgtgc agcagcagag caacctgctg
1681 aaggccatcg aggcccagca gcacatgctg cagctgaccg tgtggggcat caagcagctg
1741 caggcccgcg tgctggccat cgagcgctac ctgaaggacc agcagctgct gggcatctgg
1801 ggctgcagcg gccgcctgat ctgcaccacc gccgtgccct ggaacagcag ctggagcaac
1861 aagagcgaga aggacatctg ggacaacatg acctggatgc agtgggaccg cgagatcagc
1921 aactacaccg gcctgatcta caacctgctg gaggacagcc agaaccagca ggagaagaac
1981 gagaaggacc tgctggagct ggacaagtgg aacaacctgt ggaactggtt cgacatcagc
2041 aactggccct ggtacatcta a
```

FIGURE 112 (SEQ ID NO: 191)

gp140modC8.2mut7.delV2.Kozmod.Ta

```
   1 gccaccatgc gcgtgatggg cacccagaag aactgccagc agtggtggat ctggggcatc
  61 ctgggcttct ggatgctgat gatctgcaac accgaggacc tgtgggtgac cgtgtactac
 121 ggcgtgcccg tgtggcgcga cgccaagacc accctgttct gcgccagcga cgccaaggcc
 181 tacgagaccg aggtgcacaa cgtgtgggcc acccacgcct gcgtgcccac cgaccccaac
 241 ccccaggaga tcgtgctggg caacgtgacc gagaacttca acatgtggaa gaacgacatg
 301 gccgaccaga tgcacgagga cgtgatcagc ctgtgggacc agagcctgaa gccctgcgtg
 361 aagctgaccc ccctgtgcgt gaccctgaac tgcaccgaca ccaacgtgac cggcaaccgc
 421 accgtgaccg gcaacagcac caacaacacc aacggcaccg gcatctacaa catcgaggag
 481 atgaagaact gcagcttcaa cgccggcgcc ggccgcctga tcaactgcaa caccagcacc
 541 atcacccagg cctgccccaa ggtgagcttc gaccccatcc ccatccacta ctgcgccccc
 601 gccggctacg ccatcctgaa gtgcaacaac aagaccttca acggcaccgg ccctgctac
 661 aacgtgagca ccgtgcagtg cacccacggc atcaagcccg tggtgagcac ccagctgctg
 721 ctgaacggca gcctggccga ggagggcatc atcatccgca gcgagaacct gaccgagaac
 781 accaagacca tcatcgtgca cctgaacgag agcgtggaga tcaactgcac ccgccccaac
 841 aacaacaccc gcaagagcgt gcgcatcggc cccggccagg ccttctacgc caccaacgac
 901 gtgatcggca acatccgcca ggccactgc aacatcagca ccgaccgctg gaacaagacc
 961 ctgcagcagg tgatgaagaa gctgggcgag cacttcccca acaagaccat ccagttcaag
1021 ccccacgccg gcggcgacct ggagatcacc atgcacagct tcaactgccg cggcgagttc
1081 ttctactgca acaccagcaa cctgttcaac agcacctacc acagcaacaa cggcacctac
1141 aagtacaacg gcaacagcag cagccccatc accctgcagt gcaagatcaa gcagatcgtg
1201 cgcatgtggc agggcgtggg ccaggccacc tacgccccc ccatcgccgg caacatcacc
1261 tgccgcagca acatcaccgg catcctgctg acccgcgacg gcggcttcaa caccaccaac
1321 aacaccgaga ccttccgccc cggcggcggc gacatgcgcg acaactggcg cagcgagctg
1381 tacaagtaca aggtggtgga gatcaagccc ctgggcatcg cccccaccaa ggccatcagc
1441 agcgtggtgc agagcgagaa gagcgccgtg ggcatcggcg ccgtgttcct gggcttcctg
1501 ggcgccgccg gcagcaccat gggcgccgcc agcatcaccc tgaccgtgca ggcccgccag
1561 ctgctgagcg gcatcgtgca gcagcagagc aacctgctga aggccatcga ggcccagcag
1621 cacatgctgc agctgaccgt gtggggcatc aagcagctgc aggcccgcgt gctggccatc
1681 gagcgctacc tgaaggacca gcagctgctg ggcatctggg gctgcagcgg ccgcctgatc
1741 tgcaccaccg ccgtgccctg gaacagcagc tggagcaaca gagcgagaa ggacatctgg
1801 gacaacatga cctggatgca gtgggaccgc gagatcagca actacaccgg cctgatctac
1861 aacctgctgg aggacagcca gaaccagcag gagaagaacg agaaggacct gctggagctg
1921 gacaagtgga caaacctgtg gaactggttc gacatcagca actggcctg gtacatctaa
1981 a
```

```
         Translation of:
                                 451                                                500
      gp140mod.TV1.delV2   (451) RDNWRSELYKYKVVEIKPLGIAPTKAKRRVVQREKRAVGIGAVFLGFLGA
     gp140mod.TV1.mut1.dV2   (451) RDNWRSELYKYKVVEIKPLGIAPTKAKRRVVQREKSAVGIGAVFLGFLGA
     gp140mod.TV1.mut2.dV2   (451) RDNWRSELYKYKVVEIKPLGIAPTKAKRRVVQSEKSAVGIGAVFLGFLGA
     gp140mod.TV1.mut3.dV2   (451) RDNWRSELYKYKVVEIKPLGIAPTKAKRSVVQSEKSAVGIGAVFLGFLGA
     gp140mod.TV1.mut4.dV2   (451) RDNWRSELYKYKVVEIKPLGIAPTKAKSSVVQSEKSAVGIGAVFLGFLGA
    gp140mod.TV1.mut7.delV2   (451) RDNWRSELYKYKVVEIKPLGIAPTKAISSVVQSEKSAVGIGAVFLGFLGA
```

FIGURE 113

```
           Translation of:         101                                              150
           gp140mod.TV1     (101) QMHEDVISLWDQSLKPCVKLTPLCVTLNCTDTNVTGNRTVTGNSTNNTNG
     gp140mod.TV1.GM161     (101) QMHEDVISLWDQSLKPCVKLTPLCVTLNCTDTNVTGNRTVTGNSTNNTNG
 gp140mod.TV1.GM161-204     (101) QMHEDVISLWDQSLKPCVKLTPLCVTLNCTDTNVTGNRTVTGNSTNNTNG
gp140mod.TV1.GM161-195-204  (101) QMHEDVISLWDQSLKPCVKLTPLCVTLNCTDTNVTGNRTVTGNSTNNTNG
    gp140mod.TV1.GM-V1V2    (101) QMHEDVISLWDQSLKPCVKLTPLCVTLQCTDTQVTGQRTVTGQSTQNTQG
              Consensus     (101) QMHEDVISLWDQSLKPCVKLTPLCVTLNCTDTNVTGNRTVTGNSTNNTNG Translation of:         151                                              200
           gp140mod.TV1     (151) TGIYNIEEMKNCSFNATTELRDKKHKEYALFYRLDIVPLNENSDNFTYRL
     gp140mod.TV1.GM161     (151) TGIYNIEEMKQCSFNATTELRDKKHKEYALFYRLDIVPLNENSDNFTYRL
 gp140mod.TV1.GM161-204     (151) TGIYNIEEMKQCSFNATTELRDKKHKEYALFYRLDIVPLNENSDNFTYRL
gp140mod.TV1.GM161-195-204  (151) TGIYNIEEMKQCSFNATTELRDKKHKEYALFYRLDIVPLNENSDQFTYRL
    gp140mod.TV1.GM-V1V2    (151) TGIYNIEEMKQCSFQATTELRDKKHKEYALFYRLDIVPLNENSDQFTYRL
              Consensus     (151) TGIYNIEEMKQCSFNATTELRDKKHKEYALFYRLDIVPLNENSDNFTYRL Translation of:         201                                              250
           gp140mod.TV1     (201) INCNTSTITQACPKVSFDPIPIHYCAPAGYAILKCNNKTFNGTGPCYNVS
     gp140mod.TV1.GM161     (201) INCNTSTITQACPKVSFDPIPIHYCAPAGYAILKCNNKTFNGTGPCYNVS
 gp140mod.TV1.GM161-204     (201) INCQTSTITQACPKVSFDPIPIHYCAPAGYAILKCNNKTFNGTGPCYNVS
gp140mod.TV1.GM161-195-204  (201) INCQTSTITQACPKVSFDPIPIHYCAPAGYAILKCNNKTFNGTGPCYNVS
    gp140mod.TV1.GM-V1V2    (201) INCQTSTITQACPKVSFDPIPIHYCAPAGYAILKCNNKTFNGTGPCYNVS
              Consensus     (201) INCQTSTITQACPKVSFDPIPIHYCAPAGYAILKCNNKTFNGTGPCYNVS
```

FIGURE 114

FIGURE 115 (SEQ ID NO:203)

Nef-myrD124LLAA

ATGGCCGGCAAGTGGAGCAAGAGCAGCATCGTGGGCTGGCCCGCCGTGCGCGAGCG
CATCCGCCGCACCGAGCCCGCCGCCGAGGGCGTGGGCGCCGCCAGCCAGGACCTGG
ACAAGCACGGCGCCCTGACCAGCAGCAACACCGCCGCCAACAACGCCGACTGCGCC
TGGCTGGAGGCCCAGGAGGAGGAGGAGGAGGTGGGCTTCCCCGTGCGCCCCCAGGT
GCCCCTGCGCCCCATGACCTACAAGGCCGCCTTCGACCTGAGCTTCTTCCTGAAGGA
GAAGGGCGGCCTGGAGGGCCTGATCTACAGCAAGAAGCGCCAGGAGATCCTGGACC
TGTGGGTGTACCACACCCAGGGCTTCTTCCCCGGCTGGCAGAACTACACCCCCGGCC
CCGGCGTGCGCTACCCCCTGACCTTCGGCTGGTGCTTCAAGCTGGTGCCCGTGGACC
CCCGCGAGGTGGAGGAGGCCAACAAGGGCGAGAACAACTGCgcGgcGCACCCCATGA
GCCAGCACGGCATGGAGGACGAGGACCGCGAGGTGCTGAAGTGGAAGTTCGACAG
CAGCCTGGCCCGCCGCCACATGGCCCGCGAGCTGCACCCCGAGTACTACAAGGACT
GCGCCTAA

FIGURE 116 (SEQ ID NO:204)

Nef-myrD124LLAA

MaGKWSKSSIVGWPAVRERIRRTEPAAEGVGAASQDLDKHGALTSSNTAANNADCA
WLEAQEEEEEVGFPVRPQVPLRPMTYKAAFDLSFFLKEKGGLEGLIYSKKRQEILDL
WVYHTQGFFPgWQNYTPGPGVRYPLTFGWCFKLVPVDPREVEEANKGENNCaaHPM
SQHGMEDEDREVLKWKFDSSLARRHMARELHPEYYKDCA

FIGURE 117 (SEQ ID NO:205)

gp160mod.TV2

```
   1 atgcgcgccc gcggcatcct gaagaactac cgccactggt ggatctgggg catcctgggc
  61 ttctggatgc tgatgatgtg caacgtgaag ggcctgtggg tgaccgtgta ctacggcgtg
 121 cccgtgggcc gcgaggccaa gaccaccctg ttctgcgcca gcgacgccaa ggcctacgag
 181 aaggaggtgc acaacgtgtg ggccacccac gcctgcgtgc ccaccgaccc caaccccag
 241 gaggtgatcc tgggcaacgt gaccgagaac ttcaacatgt ggaagaacga catggtggac
 301 cagatgcagg aggacatcat cagcctgtgg gaccagagc (Sheet 1 of 1)

Figure 121

| Group | Animal | % Virus Inhibition | | | |
|---|---|---|---|---|---|
| | | Post-2nd DNA (1:20) | Post-2nd - DNA (1:100) | Post-Prot (1:100) | Post-Prot (1:500) |
| 1 | 1 | 0 | 60 | 0 | 17 |
| | 2 | 34 | 59 | 50 | 21 |
| | 3 | 0 | 0 | 12 | 38 |
| | 4 | 95 | 92 | 88 | 57 |
| 2 | 5 | 100 | 69 | 99 | 99 |
| | 6 | 0 | 28 | 27 | 35 |
| | 7 | 0 | 0 | 43 | 0 |
| | 8 | 95 | 38 | 79 | 74 |
| 3 | 9 | 40 | 0 | 61 | 26 |
| | 10 | 0 | 0 | 0 | 0 |
| | 11 | 94 | 41 | 91 | 57 |
| | 12 | 0 | 0 | 12 | 19 |
| 4 | 13 | 100 | 86 | 78 | 18 |
| | 14 | 20 | 0 | 69 | 0 |
| | 15 | 99 | 70 | 100 | 31 |
| | 16 | 0 | 33 | 0 | 24 |
| 5 | 17 | 100 | 67 | 100 | 75 |
| | 18 | 69 | 36 | 100 | 53 |
| | 19 | 58 | 33 | NA | NA |
| | 20 | 99 | 80 | 92 | 39 |
| 6 | 21 | NA | NA | NA | NA |
| | 22 | 78 | 12 | 100 | 88 |
| | 23 | 67 | 68 | 92 | 17 |
| | 24 | 70 | 62 | 77 | 0 |
| 7 | 29 | 100 | 100 | 74 | 68 |
| | 30 | 81 | 69 | 55 | 28 |
| | 31 | 100 | 79 | 100 | 91 |
| | 32 | 100 | 78 | 100 | 45 |
| Sub B positive serum | 20480 | 100 | 100 | 100 | 100 |

Figure 122

| Group | Animal | % Virus Inhibition | | ELISA Titer |
|---|---|---|---|---|
| | | TV1 | TV2 | |
| 1 | 1 | 0 | 38 | 19716 |
| | 2 | 25 | 67 | 37994 |
| | 3 | 0 | 0 | 7529 |
| | 4 | 0 | 79 | 41963 |
| 2 | 5 | 30 | 51 | 112768 |
| | 6 | 0 | 0 | 57677 |
| | 7 | 23 | 9 | 26247 |
| | 8 | 47 | 78 | 90376 |
| 3 | 9 | 0 | 42 | 62004 |
| | 10 | 13 | 0 | 5741 |
| | 11 | 0 | 36# | 53599 |
| | 12 | 21 | 12 | 37597 |
| 4 | 13 | 0 | 22# | 45543 |
| | 14 | 0 | 0 | 24885 |
| | 15 | 0 | 17# | 87556 |
| | 16 | 28# | 59 | 19838 |
| 5 | 17 | 72 | 80 | 124618 |
| | 18 | 0 | 77 | 143905 |
| | 19 | NA | NA | NA |
| | 20 | 19 | 56 | 91808 |
| 6 | 21 | NA | NA | NA |
| | 22 | 34 | 44 | 31413 |
| | 23 | 51 | 50 | 62925 |
| | 24 | 22 | 31# | 28620 |
| | 29 | 0 | 9 | 62604 |
| | 30 | 0 | 50 | 15932 |
| | 31 | 0 | 58 | 22418 |
| | 32 | 41 | 0 | 21119 |
| Sub B positive pool | | 46 | 56 | NA |
| Sub C positive pool | | 36 | 85 | NA |

Figure 123

| Group | Animal | % Virus Inhibition | | | ELISA titer |
|---|---|---|---|---|---|
| | | TV1 | Du174 | SF162 | |
| 1 | 1 | 28 | 20 | 12 | 19716 |
| | 2 | 33 | 19 | 9 | 37994 |
| | 3 | 0 | 0 | 0 | 7529 |
| | 4 | 52 | 61 | 79 | 41963 |
| 2 | 5 | 33 | 0 | 95 | 112768 |
| | 6 | 3 | 0 | 14 | 57677 |
| | 7 | 0 | 0 | 0 | 26247 |
| | 8 | 54 | 0 | 86 | 90376 |
| 3 | 9 | 0 | 52 | 73 | 62004 |
| | 10 | 0 | 58 | 15 | 5741 |
| | 11 | 0 | 0 | 71 | 53599 |
| | 12 | 0 | 0 | 0 | 37597 |
| 4 | 13 | 15 | 0 | 69 | 45543 |
| | 14 | 0 | 0 | 0 | 24885 |
| | 15 | 0 | 13 | 0 | 87556 |
| | 16 | 14 | 0 | 0 | 19838 |
| 5 | 17 | 0 | 0 | 0 | 124618 |
| | 18 | 0 | 0 | 30 | 143905 |
| | 19 | NA | NA | NA | NA |
| | 20 | 63 | 0 | 56 | 91808 |
| 6 | 21 | NA | NA | NA | NA |
| | 22 | 24 | NV | 38 | 31413 |
| | 23 | 7 | 65 | 76 | 62925 |
| | 24 | 0 | NV | NV | 28620 |
| 7 | 29 | 32 | 0 | 82 | 62604 |
| | 30 | 6 | NV | 0 | 15932 |
| | 31 | 0 | 0 | 98 | 22418 |
| | 32 | 34 | 0 | 0 | 21119 |

POLYNUCLEOTIDES ENCODING ANTIGENIC HIV TYPE C POLYPEPTIDES, POLYPEPTIDES AND USES THEREOF

CROSS-REFERENCE TO RELATED APPLICATIONS

This application is related to U.S. Provisional Patent Applications Ser. Nos. 60/303,192, filed Jul. 5, 2001, 60/316,860, filed Aug. 31, 2001, and 60/349,871, filed 16 Jan. 2002, from which priority is claimed under 35 USC §119(e)(1), and which applications are incorporated herein by reference in their entireties.

GOVERNMENT SUPPORT

The invention was supported, in whole or in part, by NIH HIVDDT Grant No. N01-AI-05396 from the National Institutes of Health. The Government may have certain rights in the invention.

TECHNICAL FIELD

Polynucleotides encoding antigenic HIV polypeptides (e.g., those shown in Table C) are described, as are uses of these polynucleotides and polypeptide products including formulations of immunogenic compositions and uses thereof.

BACKGROUND OF THE INVENTION

Acquired immune deficiency syndrome (AIDS) is recognized as one of the greatest health threats facing modern medicine. There is, as yet, no cure for this disease.

In 1983–1984, three groups independently identified the suspected etiological agent of AIDS. See, e.g., Barre-Sinoussi et al. (1983) Science 220:868–871; Montagnier et al., in Human T-Cell Leukemia Viruses (Gallo, Essex & Gross, eds., 1984); Vilmer et al. (1984) The Lancet 1:753; Popovic et al. (1984) Science 224:497–500; Levy et al. (1984) Science 225:840–842. These isolates were variously called lymphadenopathy-associated virus (LAV), human T-cell lymphotropic virus type III (HTLV-III), or AIDS-associated retrovirus (ARV). All of these isolates are strains of the same virus, and were later collectively named Human Immunodeficiency Virus (HIV). With the isolation of a related AIDS-causing virus, the strains originally called HIV are now termed HIV-1 and the related virus is called HIV-2 See, e.g., Guyader et al. (1987) Nature 326:662–669; Brun-Vezinet et al. (1986) Science 233:343–346; Clavel et al. (1986) Nature 324:691–695.

A great deal of information has been gathered about the HIV virus, however, to date an effective vaccine has not been identified. Several targets for vaccine development have been examined including the env and Gag gene products encoded by HIV. Gag gene products include, but are not limited to, Gag-polymerase and Gag-protease. Env gene products include, but are not limited to, monomeric gp120 polypeptides, oligomeric gp140 polypeptides and gp160 polypeptides.

Haas, et al., (*Current Biology* 6(3):315–324, 1996) suggested that selective codon usage by HIV-1 appeared to account for a substantial fraction of the inefficiency of viral protein synthesis. Andre, et al., (*J. Virol.* 72(2):1497–1503, 1998) described an increased immune response elicited by DNA vaccination employing a synthetic gp120 sequence with modified codon usage. Schneider, et al., (*J. Virol.* 71(7):4892–4903, 1997) discuss inactivation of inhibitory (or instability) elements (INS) located within the coding sequences of the Gag and Gag-protease coding sequences.

The Gag proteins of HIV-1 are necessary for the assembly of virus-like particles. HIV-1 Gag proteins are involved in many stages of the life cycle of the virus including, assembly, virion maturation after particle release, and early post-entry steps in virus replication. The roles of HIV-1 Gag proteins are numerous and complex (Freed, E. O., *Virology* 251:1–15, 1998).

Wolf, et al., (PCT International Application, WO 96/30523, published Oct. 3, 1996; European Patent Application, Publication No. 0 449 116 A1, published 2 Oct. 1991) have described the use of altered pr55 Gag of HIV-1 to act as a non-infectious retroviral-like particulate carrier, in particular, for the presentation of immunologically important epitopes. Wang, et al., (*Virology* 200:524–534, 1994) describe a system to study assembly of HIV Gag-β-galactosidase fusion proteins into virions. They describe the construction of sequences encoding HIV Gag-β-galactosidase fusion proteins, the expression of such sequences in the presence of HIV Gag proteins, and assembly of these proteins into virus particles.

Shiver, et al., (PCT International Application, WO 98/34640, published 13 Aug. 1998) described altering HIV-1 (CAM 1) Gag coding sequences to produce synthetic DNA molecules encoding HIV Gag and modifications of HIV Gag. The codons of the synthetic molecules were codons preferred by a projected host cell.

Recently, use of HIV Env polypeptides in immunogenic compositions has been described. (see, U.S. Pat. No. 5,846,546 to Hurwitz et al., issued Dec. 8, 1998, describing immunogenic compositions comprising a mixture of at least four different recombinant virus that each express a different HIV env variant; and U.S. Pat. No. 5,840,313 to Vahlne et al., issued Nov. 24, 1998, describing peptides which correspond to epitopes of the HIV-1 gp120 protein). In addition, U.S. Pat. No. 5,876,731 to Sia et al, issued Mar. 2, 1999 describes candidate vaccines against HIV comprising an amino acid sequence of a T-cell epitope of Gag linked directly to an amino acid sequence of a B-cell epitope of the V3 loop protein of an HIV-1 isolate containing the sequence GPGR.

SUMMARY OF THE INVENTION

Described herein are novel HIV sequences, polypeptides encoded by these novel sequences, and synthetic expression cassettes generated from these and other HIV sequences. In one aspect, the present invention relates to improved HIV expression cassettes. In a second aspect, the present invention relates to generating an immune response in a subject using the expression cassettes of the present invention. In a further aspect, the present invention relates to generating an immune response in a subject using the expression cassettes of the present invention, as well as, polypeptides encoded by the expression cassettes of the present invention. In another aspect, the present invention relates to enhanced vaccine technologies for the induction of potent neutralizing antibodies and/or cellular immune responses against HIV in a subject.

In certain embodiments, the present invention relates to isolated wild-type polynucleotides and/or expression cassettes encoding HIV polypeptides, including, but not limited to, Env, Gag, Pol, Prot, RT, Int, Vpr, Vpu, Vif, Nef, Tat, Rev and/or combinations and fragments thereof. Mutations in some of the genes are described that reduce or eliminate the activity of the gene product without adversely affecting the ability of the gene product to generate an immune response. Exemplary polynucleotides include, but are not limited to, EnvTV001c8.2 (SEQ ID NO:61), EnvTV001c8.5 (SEQ ID NO:62), EnvTV001c12.1 (SEQ ID NO:63), Env TV003cE260 (SEQ ID NO:64), EnvTV004cC300 (SEQ ID NO:65), EnvTV006c9.1 (SEQ ID NO:66), EnvTV006c9.2 (SEQ ID NO:67), EnvTV006cE9 (SEQ ID NO:68), EnvTV007cB104 (SEQ ID NO:69), EnvTV007cB 105 (SEQ ID NO:70), EnvTV008c4.3 (SEQ ID NO:71), EnvTV008c4.4 (SEQ ID NO:72), EnvTV010cD7 (SEQ ID NO:73), EnvTV012c2.1 (SEQ ID NO:74), EnvTV012c2.2 (SEQ ID NO:75), EnvTV013cB20 (SEQ ID NO:76), EnvTV013CH17 (SEQ ID NO:77), EnvTV014c6.3 (SEQ ID NO:78), EnvTV014c6.4 (SEQ ID NO:79), EnvTV018cF1027 (SEQ ID NO:80), EnvTV019c5 (SEQ ID NO:81), GagTV001G8 (SEQ ID NO:82), GagTV001G11 (SEQ ID NO:83), GagTV002G8 (SEQ ID NO:84), GagTV003G15 (SEQ ID NO:85), GagTV004G17 (SEQ ID NO:86), GagTV004G24 (SEQ ID NO:87), GagTV006G11 (SEQ ID NO:88), GagTV006G97 (SEQ ID NO:89), GagTV007G59 (SEQ ID NO:90), GagTV008G65 (SEQ ID NO:91), GagTV008G66 (SEQ ID NO:92), GagTV010G74 (SEQ ID NO:93), GagTV012G34 (SEQ ID NO:94), GagTV012G40 (SEQ ID NO:95), GagTV013G2 (SEQ ID NO:96), GagTV013G15 (SEQ ID NO:97), GagTV014G73 (SEQ ID NO:98), GagTV018G60 (SEQ ID NO:99), GagTV019G20 (SEQ ID NO:100), GagTV019G25 (SEQ ID NO:101), 8_2_TV1 LTR (SEQ ID NO:181), and 2_¼_TV12_C_ZA (SEQ ID NO:182).

In other embodiments, the present invention relates synthetic polynucleotides and/or expression cassettes encoding HIV polypeptides, including but not limited to Env, Gag, Pol, Prot, Int, Vpr, Vpu, Vif, Nef, Tat, Rev and/or combinations and fragments thereof. In addition, the present invention also relates to improved expression of HIV polypeptides and production of virus-like particles. Synthetic expression cassettes encoding the HIV polypeptides (e.g., Gag-, pol-, protease (prot)-, reverse transcriptase, integrase, RNAseH, Tat, Rev, Nef, Vpr, Vpu, Vif and/or Env-containing polypeptides) are described, as are uses of the expression cassettes. Mutations in some of the genes are described that reduce or eliminate the activity of the gene product without adversely affecting the ability of the gene product to generate an immune response. Exemplary synthetic polynucleotides include, but are not limited to, GagComplPolmut_C (SEQ ID NO:9), GagComplPolmutAtt_C (SEQ ID NO: 10), GagComplPolmutIna_C (SEQ ID NO:11), GagComplPolmutInaTatRevNef_C (SEQ ID NO:12), GagPolmut_C (SEQ ID NO: 13), GagPolmutAtt_C (SEQ ID NO:14), GagPolmutIna_C (SEQ ID NO:15), GagProtInaRTmut_C (SEQ ID NO:16), GagProtInaRTmutTatRevNef_C (SEQ ID NO: 17), GagRTmut_C (SEQ ID NO:18), GagRTmutTatRevNef_C (SEQ ID NO:19), GagTatRevNef_C (SEQ ID NO:20), gp120mod.TV1.del118-210 (SEQ ID NO:21), gp120mod.TV1.delV1V2 (SEQ ID NO:22), gp120mod.TV1.delV2 (SEQ ID NO:23), gp140mod.TV1.del118-210 (SEQ ID NO:24), gp140mod.TV1.delV1V2 (SEQ ID NO:25), gp140mod.TV1.delV2 (SEQ ID NO:26), gp140mod.TV1.mut7 (SEQ ID NO:27), gp140mod.TV1.tpa2 (SEQ ID NO:28), gp140TMmod.TV1 (SEQ ID NO:29), gp160mod.TV1.del118-210 (SEQ ID NO:30), gp160mod.TV1.delV1V2 (SEQ ID NO:31), gp160mod.TV1.delV2 (SEQ ID NO:32), gp160mod.TV1.dV1 (SEQ ID NO:33), gp160mod.TV1.dV1-gagmod.BW965 (SEQ ID NO:34), gp160mod.TV1.dV1V2-gagmod.BW965 (SEQ ID NO:35), gp160mod.TV1.dV2-gagmod.BW965 (SEQ ID NO:36), gp160mod.TV1.tpa2 (SEQ ID NO:37), gp160mod.TV1-gagmod.BW965 (SEQ ID NO:38), int.opt.mut_C (SEQ ID NO:39), int.opt_C (SEQ ID NO:40), nef.D106G.-myr19.opt_C (SEQ ID NO:41), p15RnaseH.opt_C (SEQ ID NO:42), p2Pol.opt.YMWM_C (SEQ ID NO:43), p2Polopt.YM_C (SEQ ID NO:44), p2Polopt_C (SEQ ID NO:45), p2PolTatRevNef opt C (SEQ ID NO:46), p2PolTatRevNef.opt.native_C (SEQ ID NO:47), p2PolTatRevNef.opt_C (SEQ ID NO:48), protInaRT.YM.opt_C (SEQ ID NO:49), protInaRT.YMWM.opt_C (SEQ ID NO:50), ProtRT.TatRevNef.opt_C (SEQ ID NO:51), rev.exon1_2.M5-10.opt_C (SEQ ID NO:52), tat.exon1_2.opt.C22-37_C (SEQ ID NO:53), tat.exon1_2.opt.C37_C (SEQ ID NO:54), TatRevNef.opt.native_ZA (SEQ ID NO:55), TatRevNef.opt_ZA (SEQ ID NO:56), TatRevNefGag C (SEQ ID NO:57), TatRevNefgagCpolIna C (SEQ ID NO:58), TatRevNefGagProtInaRTmut C (SEQ ID NO:59), TatRevNefProtRT opt C (SEQ ID NO:60), gp140.modTV1.mut1.dV2 (SEQ ID NO:183); gp140mod.TV1.mut2.dV2 (SEQ ID NO:184), gp140mod.TV1.mut3.dV2 (SEQ ID NO:185), gp140mod.TV1.mut4.dV2 (SEQ ID NO:186), gp140.mod.TV1.GM161 (SEQ ID NO:187), gp140mod.TV1.GM161-195-204 (SEQ ID NO:188), gp140mod.TV1.GM161-204 (SEQ ID NO:189), gp140mod.TV1.GM-V1V2 (SEQ ID NO: 190), gp140modC8.2mut7.delV2.Kozmod.Ta (SEQ ID NO:191), and Nef-myrD124LLAA (SEQ ID NO:203).

Thus, one aspect of the present invention relates to expression cassettes and polynucleotides contained therein. The expression cassettes typically include an HIV-polypeptide encoding sequence inserted into an expression vector backbone. In one embodiment, an expression cassette comprises a polynucleotide sequence encoding one or more polypeptides, wherein the polynucleotide sequence comprises a sequence having between about 85% to 100% and any integer values therebetween, for example, at least about 85%, preferably about 90%, more preferably about 95%, and more preferably about 98% sequence identity to the sequences taught in the present specification.

The polynucleotides encoding the HIV polypeptides of the present invention may also include sequences encoding additional polypeptides. Such additional polynucleotides encoding polypeptides may include, for example, coding sequences for other viral proteins (e.g., hepatitis B or C or other HIV proteins, such as, polynucleotide sequences encoding an HIV Gag polypeptide, polynucleotide sequences encoding an HIV Env polypeptide and/or polynucleotides encoding one or more of vif, vpr, tat, rev, vpu and nef); cytokines or other transgenes.

In one embodiment, the sequence encoding the HIV Pol polypeptide(s) can be modified by deletions of coding regions corresponding to reverse transcriptase and integrase. Such deletions in the polymerase polypeptide can also be made such that the polynucleotide sequence preserves T-helper cell and CTL epitopes. Other antigens of interest may be inserted into the polymerase as well.

In another embodiment, an expression cassette comprises a polynucleotide sequence encoding a polypeptide, for example, GagComplPolmut_C (SEQ ID NO:9), GagComplPolmutAtt_C (SEQ ID NO:10), GagComplPolmutIna_C (SEQ ID NO:11), GagComplPolmutInaTatRevNef_C (SEQ ID NO:12), GagPolmut_C (SEQ ID NO: 13), GagPolmutAtt_C (SEQ ID NO:14), GagPolmutIna_C (SEQ ID NO:15), GagProtInaRTmut_C (SEQ ID NO:16), GagProtInaRTmutTatRevNef_C (SEQ ID NO: 17), GagRTmut_C (SEQ ID NO:18), GagRTmutTatRevNef_C (SEQ ID NO:19), GagTatRevNef_C (SEQ ID NO:20), gp120mod.TV1.del118-210 (SEQ ID NO:21), gp120mod.TV1.delV1V2 (SEQ ID NO:22), gp120mod.TV1.delV2 (SEQ ID NO:23), gp140mod.TV1.del118-210 (SEQ ID NO:24), gp140mod.TV1.delV1V2 (SEQ ID NO:25), gp140mod.TV1.delV2 (SEQ ID NO:26), gp140mod.TV1.mut7 (SEQ ID NO:27), gp140mod.TV1.tpa2 (SEQ ID NO:28), gp140TMmod.TV1 (SEQ ID NO:29), gp160mod.TV1.del118-210 (SEQ ID NO:30), gp160mod.TV1.delV1V2 (SEQ ID NO:31), gp160mod.TV1.delV2 (SEQ ID NO:32), gp160mod.TV1.dV1 (SEQ ID NO:33), gp160mod.TV1.dV1-gagmod.BW965 (SEQ ID NO:34), gp160mod.TV1.dV1V2-gagmod.BW965 (SEQ ID NO:35), gp160mod.TV1.dV2-gagmod.BW965 (SEQ ID NO:36), gp160mod.TV1.tpa2 (SEQ ID NO:37), gp160mod.TV1-gagmod.BW965 (SEQ ID NO:38), int.opt.mut_C (SEQ ID NO:39), int.opt_C (SEQ ID NO:40), nef.D106G.-myr19.opt_C (SEQ ID NO:41), p15RnaseH.opt_C (SEQ ID NO:42), p2Pol.opt.YMWM_C (SEQ ID NO:43), p2Polopt.YM_C (SEQ ID NO:44), p2Polopt_C (SEQ ID NO:45), p2PolTatRevNef opt C (SEQ ID NO:46), p2PolTatRevNef.opt.native_C (SEQ ID NO:47), p2PolTatRevNef.opt_C (SEQ ID NO:48), protInaRT.Y-M.opt_C (SEQ ID NO:49), protInaRT.YMWM.opt_C (SEQ ID NO:50), ProtRT.TatRevNef.opt_C (SEQ ID NO:51), rev.exon1_2.M5-10.opt_C (SEQ ID NO:52), tat.exon1_2.opt.C22-37_C (SEQ ID NO:53), tat.exon1_2.opt.C37_C. (SEQ ID NO:54), TatRevNef.opt.native_ZA (SEQ ID NO:55), TatRevNef.opt_ZA (SEQ ID NO:56), TatRevNef-Gag C (SEQ ID NO:57), TatRevNefgagCpoIna C (SEQ ID NO:58), TatRevNefGagProtInaRTmut C (SEQ ID NO:59), and TatRevNefProtRT opt C (SEQ ID NO:60), wherein the polynucleotide sequence encoding the polypeptide comprises a sequence having between about 85% to 100% and any integer values therebetween, for example, at least about 85%, preferably about 90%, more preferably about 95%, and more preferably about 98% sequence identity to the sequences taught in the present specification.

The native and synthetic polynucleotide sequences encoding the HIV polypeptides of the present invention typically have between about 85% to 100% and any integer values therebetween, for example, at least about 85%, preferably about 90%, more preferably about 95%, and more preferably about 98% sequence identity to the sequences taught herein. Further, in certain embodiments, the polynucleotide sequences encoding the HIV polypeptides of the invention will exhibit 100% sequence identity to the sequences taught herein.

The polynucleotides of the present invention can be produced by recombinant techniques, synthetic techniques, or combinations thereof.

The present invention further includes recombinant expression systems for use in selected host cells, wherein the recombinant expression systems employ one or more of the polynucleotides and expression cassettes of the present invention. In such systems, the polynucleotide sequences are operably linked to control elements compatible with expression in the selected host cell. Numerous expression control elements are known to those in the art, including, but not limited to, the following: transcription promoters, transcription enhancer elements, transcription termination signals, polyadenylation sequences, sequences for optimization of initiation of translation, and translation termination sequences. Exemplary transcription promoters include, but are not limited to those derived from CMV, CMV+intron A, SV40, RSV, HIV-Ltr, MMLV-1tr, and metallothionein.

In another aspect the invention includes cells comprising one or more of the expression cassettes of the present invention where the polynucleotide sequences are operably linked to control elements compatible with expression in the selected cell. In one embodiment such cells are mammalian cells. Exemplary mammalian cells include, but are not limited to, BHK, VERO, HT1080, 293, RD, COS-7, and CHO cells. Other cells, cell types, tissue types, etc., that may be useful in the practice of the present invention include, but are not limited to, those obtained from the following: insects (e.g., *Trichoplusia ni* (Tn5) and Sf9), bacteria, yeast, plants, antigen presenting cells (e.g., macrophage, monocytes, dendritic cells, B-cells, T-cells, stem cells, and progenitor cells thereof), primary cells, immortalized cells, tumor-derived cells.

In a further aspect, the present invention includes compositions for generating an immunological response, where the composition typically comprises at least one of the expression cassettes of the present invention and may, for example, contain combinations of expression cassettes such as one or more expression cassettes carrying a Pol-derived-polypeptide-encoding polynucleotide, one or more expression cassettes carrying a Gag-derived-polypeptide-encoding polynucleotide, one or more expression cassettes carrying accessory polypeptide-encoding polynucleotides (e.g., native or synthetic vpu, vpr, nef, vif, tat, rev), and/or one or more expression cassettes carrying an Env-derived-polypeptide-encoding polynucleotide. Such compositions may further contain an adjuvant or adjuvants. The compositions may also contain one or more HIV polypeptides. The HIV polypeptides may correspond to the polypeptides encoded by the expression cassette(s) in the composition, or may be different from those encoded by the expression cassettes. In compositions containing both expression cassettes (or polynucleotides of the present invention) and polypeptides, various expression cassettes of the present invention can be mixed and/or matched with various HIV polypeptides described herein.

In another aspect the present invention includes methods of immunization of a subject. In the method any of the above described compositions are into the subject under conditions that are compatible with expression of the expression cassette(s) in the subject. In one embodiment, the expression cassettes (or polynucleotides of the present invention) can be introduced using a gene delivery vector. The gene delivery vector can, for example, be a non-viral vector or a viral vector. Exemplary viral vectors include, but are not limited to eucaryotic layered vector initiation systems, Sindbis-virus (or other alphavirus) derived vectors, retroviral vectors, and lentiviral vectors. Other exemplary vectors include, but are not limited to, pCMVKm2, pCMV6a, pCMV-link, and pCMVPLEdhfr. Compositions useful for generating an immunological response can also be delivered using a particulate carrier (e.g., PLG or CTAB-PLG microparticles). Further, such compositions can be coated on, for example, gold or tungsten particles and the coated particles delivered to the subject using, for example, a gene gun. The compositions can also be formulated as liposomes. In one embodiment of this method, the subject is a mammal and can, for example, be a human.

In a further aspect, the invention includes methods of generating an immune response in a subject. Any of the expression cassettes described herein can be expressed in a suitable cell to provide for the expression of the HIV polypeptides encoded by the polynucleotides of the present invention. The polypeptide(s) are then isolated (e.g., substantially purified) and administered to the subject in an amount sufficient to elicit an immune response. In certain embodiments, the methods comprise administration of one or more of the expression cassettes or polynucleotides of the present invention, using any of the gene delivery techniques described herein. In other embodiments, the methods comprise co-administration of one or more of the expression cassettes or polynucleotides of the present invention and one or more polypeptides, wherein the polypeptides can be expressed from these polynucleotides or can be other HIV polypeptides. In other embodiments, the methods comprise co-administration of multiple expression cassettes or polynucleotides of the present invention. In still further embodiments, the methods comprise co-administration of multiple polypeptides, for example polypeptides expressed from the polynucleotides of the present invention and/or other HIV polypeptides.

The invention further includes methods of generating an immune response in a subject, where cells of a subject are transfected with any of the above-described expression cassettes or polynucleotides of the present invention, under conditions that permit the expression of a selected polynucleotide and production of a polypeptide of interest (e.g., encoded by any expression cassette of the present invention). By this method an immunological response to the polypeptide is elicited in the subject. Transfection of the cells may be performed ex vivo and the transfected cells are reintroduced into the subject. Alternately, or in addition, the cells may be transfected in vivo in the subject. The immune response may be humoral and/or cell-mediated (cellular). In a further embodiment, this method may also include administration of an HIV polypeptides before, concurrently with, and/or after introduction of the expression cassette into the subject.

The polynucleotides of the present invention may be employed singly or in combination. The polynucleotides of the present invention, encoding HIV-derived polypeptides, may be expressed in a variety of ways, including, but not limited to the following: a polynucleotide encoding a single gene product (or portion thereof) expressed from a promoter; multiple polynucleotides encoding a more than one gene product (or portion thereof) (e.g., polycistronic coding sequences); multiple polynucleotides in-frame to produce a single polyprotein; and, multiple polynucleotides in-frame to produce a single polyprotein wherein the polyprotein has protein cleavage sites between one or more of the polypeptides comprising the polyprotein.

These and other embodiments of the present invention will readily occur to those of ordinary skill in the art in view of the disclosure herein.

BRIEF DESCRIPTION OF THE FIGURES

FIGS. 1A to 1D depict the nucleotide sequence of HIV Type C 8_5_TV1_C.ZA (SEQ ID NO:1; referred to herein as TV1). Various regions are shown in Table A.

FIGS. 2A–C depicts an alignment of Env polypeptides from various HIV isolates (SF162, SEQ ID NO:2; TV1.8_2, SEQ ID NO:3; TV1.8_5, SEQ ID NO:4; TV2.12-5/1, SEQ ID NO:5; Consensus Sequence, SEQ ID NO:6). The regions between the arrows indicate regions (of TV1 and TV2 clones, both HIV Type C isolates) in the beta and/or bridging sheet region(s) that can be deleted and/or truncated. The "*" denotes N-linked glycosylation sites (of TV1 and TV2 clones), one or more of which can be modified (e.g., deleted and/or mutated).

FIGS. 6A and 6B present the sequence of the construct GagComplPolmut_C (SEQ ID NO:9).

FIGS. 7A and 7B present the sequence of the construct GagComplPolmutAtt_C (SEQ ID NO:10).

FIGS. 8A and 8B present the sequence of the construct GagComplPolmutIna_C (SEQ ID NO:11).

FIGS. 9A and 9B present the sequence of the construct GagComplPolmutInaTatRevNef_C (SEQ ID NO:12).

FIG. 10, presents the sequence of the construct GagPolmut_C (SEQ ID NO:13).

FIG. 11, presents the sequence of the construct GagPolmutAtt_C (SEQ ID NO: 14).

FIG. 12, presents the sequence of the construct GagPolmutIna_C (SEQ ID NO: 15).

FIG. 13, presents the sequence of the construct GagProtInaRTmut_C (SEQ ID NO:16).

FIGS. 14A and 14B present the sequence of the construct GagProtInaRTmutTatRevNef_C (SEQ ID NO:17).

FIG. 15, presents the sequence of the construct GagRTmut_C (SEQ ID NO: 18).

FIGS. 16A and 16B present the sequence of the construct GagRTmutTatRevNef_C (SEQ ID NO:19).

FIG. 17, presents the sequence of the construct GagTatRevNef_C (SEQ ID NO:20).

FIG. 18, presents the sequence of the construct gp120mod.TV1.del118-210 (SEQ ID NO:21).

FIG. 19, presents the sequence of the construct gp120mod.TV1.delV1V2 (SEQ ID NO:22).

FIG. 20, presents the sequence of the construct gp120mod.TV1.delV2 (SEQ ID NO:23).

FIG. 21, presents the sequence of the construct gp140mod.TV1.del118-210 (SEQ ID NO:24).

FIG. 22, presents the sequence of the construct gp140mod.TV1.delV1V2 (SEQ ID NO:25).

FIG. 23, presents the sequence of the construct gp140mod.TV1.delV2 (SEQ ID NO:26).

FIG. 24, presents the sequence of the construct gp140mod.TV1.mut7 (SEQ ID NO:27).

FIG. 25, presents the sequence of the construct gp140mod.TV1.tpa2 (SEQ ID NO:28).

FIG. 26, presents the sequence of the construct gp140TMmod.TV1 (SEQ ID NO:29).

Figure 27:
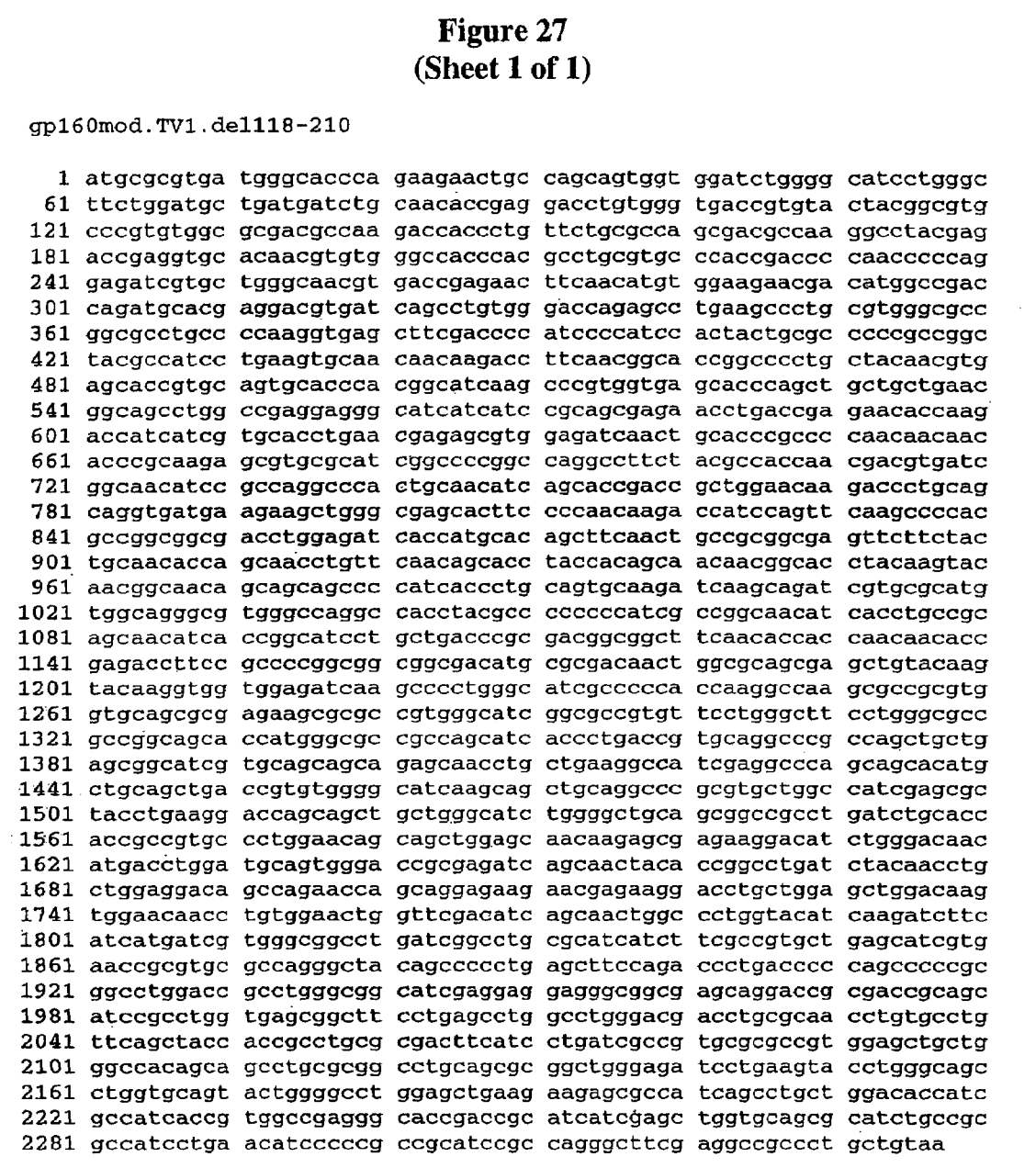

FIG. 27, presents the sequence of the construct gp160mod.TV1.del118-210 (SEQ ID NO:30).

FIG. 28, presents the sequence of the construct gp160mod.TV1.delV1V2 (SEQ ID NO:31).

FIG. 29, presents the sequence of the construct gp160mod.TV1.delV2 (SEQ ID NO:32).

FIG. 30, presents the sequence of the construct gp160mod.TV1.dV1 (SEQ ID NO:33).

FIGS. 31A and 31B present the sequence of the construct gp160mod.TV1.dV1-gagmod.BW965 (SEQ ID NO:34).

FIGS. 32A and 32B present the sequence of the construct gp160mod.TV1.dV1V2-gagmod.BW965 (SEQ ID NO:35).

FIGS. 33A and 33B present the sequence of the construct gp160mod.TV1.dV2-gagmod.BW965 (SEQ ID NO:36).

FIG. 34, presents the sequence of the construct gp160mod.TV1.tpa2 (SEQ ID NO:37).

FIGS. 35A and 35B present the sequence of the construct gp160mod.TV1-gagmod.BW965 (SEQ ID NO:38).

FIG. 36, presents the sequence of the construct int.opt-.mut_C (SEQ ID NO:39).

FIG. 37, presents the sequence of the construct int.opt_C (SEQ ID NO:40).

FIG. 38, presents the sequence of the construct nef.D106G.-myr19.opt_C (SEQ ID NO:41).

FIG. 39, presents the sequence of the construct p15RnaseH.opt_C (SEQ ID NO:42).

FIG. 40, presents the sequence of the construct p2Pol.opt.YMWM_C (SEQ ID NO:43).

FIG. 41, presents the sequence of the construct p2Polopt.YM_C (SEQ ID NO:44).

FIG. 42, presents the sequence of the construct p2Polopt_C (SEQ ID NO:45).

FIG. 43, presents the sequence of the construct p2PolTatRevNef opt C (SEQ ID NO:46).

FIG. 44, presents the sequence of the construct p2PolTatRevNef.opt.native_C (SEQ ID NO:47).

FIG. 45, presents the sequence of the construct p2PolTatRevNef.opt_C (SEQ ID NO:48).

FIG. 46, presents the sequence of the construct protInaR-T.YM.opt_C (SEQ ID NO:49).

FIG. 47, presents the sequence of the construct protInaR-T.YMWM.opt_C (SEQ ID NO:50).

FIG. 48, presents the sequence of the construct ProtRT.TatRevNef.opt_C (SEQ ID NO:51).

FIG. 49, presents the sequence of the construct rev.exon1_2.M5-10.opt_C (SEQ ID NO:52).

FIG. 50, presents the sequence of the construct tat.exon1_2.opt.C22-37_C (SEQ ID NO:53).

FIG. 51, presents the sequence of the construct tat.exon1_2.opt.C37_C (SEQ ID NO:54).

FIG. 52, presents the sequence of the construct TatRevNef.opt.native_ZA (SEQ ID NO:55).

FIG. 53, presents the sequence of the construct TatRevNef.opt_ZA (SEQ ID NO:56).

FIG. 54, presents the sequence of the construct TatRevNefGag C (SEQ ID NO:57).

FIGS. 55A and 55B present the sequence of the construct TatRevNefgagCpolIna C (SEQ ID NO:58).

FIGS. 56A and 56B present the sequence of the construct TatRevNefGagProtInaRTmut C (SEQ ID NO:59).

FIG. 57, presents the sequence of the construct TatRevNefProtRT opt C (SEQ ID NO:60).

FIG. 58 presents the sequence of Env of clone TV001c8.2 of isolate C-98TV001 (SEQ ID NO:61).

FIG. 59 presents the sequence of Env of clone TV001c8.5 of isolate C-98TV001 (SEQ ID NO:62).

FIG. 60 presents the sequence of Env of clone TV001c12.1 of isolate C-98TV002 (SEQ ID NO:63).

FIG. 61 presents the sequence of Env of clone TV003cE260 of isolate C-98TV003 (SEQ ID NO:64).

FIG. 62 presents the sequence of Env of clone TV004cC300 of isolate C-98TV004 (SEQ ID NO:65).

FIG. 63 presents the sequence of Env of clone TV006c9.1 of isolate C-98TV006 (SEQ ID NO:66).

FIG. 64 presents the sequence of Env of clone TV006c9.2 of isolate C-98TV006 (SEQ ID NO:67).

FIG. 65 presents the sequence of Env of clone TV006cE9 of isolate C-98TV006 (SEQ ID NO:68).

FIG. 66 presents the sequence of Env of clone TV007cB104 of isolate C-98TV007 (SEQ ID NO:69).

FIG. 67 presents the sequence of Env of clone TV007cB105 of isolate C-98TV007 (SEQ ID NO:70).

FIG. 68 presents the sequence of Env of clone TV008c4.3 of isolate C-98TV008 (SEQ ID NO:71).

FIG. 69 presents the sequence of Env of clone TV008c4.4 of isolate C-98TV008 (SEQ ID NO:72).

FIG. 70 presents the sequence of Env of clone TV010cD7 of isolate C-98TV010 (SEQ ID NO:73).

FIG. 71 presents the sequence of Env of clone TV012c2.1 of isolate C-98TV012 (SEQ ID NO:74).

FIG. 72 presents the sequence of Env of clone TV012c2.2 of isolate C-98TV012 (SEQ ID NO:75).

FIG. 73 presents the sequence of Env of clone TV013cB20 of isolate C-98TV013 (SEQ ID NO:76).

FIG. 74 presents the sequence of Env of clone TV013cH17 of isolate C-98TV013 (SEQ ID NO:77).

FIG. 75 presents the sequence of Env of clone TV014c6.3 of isolate C-98TV014 (SEQ ID NO:78).

FIG. 76 presents the sequence of Env of clone TV014c6.4 of isolate C-98TV014 (SEQ ID NO:79).

FIG. 77 presents the sequence of Env of clone TV018cF1027 of isolate C-98TV018 (SEQ ID NO:80).

FIG. 78 presents the sequence of Env of clone TV019c5 of isolate C-98TV019 (SEQ ID NO:81).

FIG. 79 presents the sequence of Gag of clone TV001G8 of isolate C-98TV001 (SEQ ID NO:82).

FIG. 80 presents the sequence of Gag of clone TV001G11 of isolate C-98TV001 (SEQ ID NO:83).

FIG. 81 presents the sequence of Gag of clone TV002G8 of isolate C-98TV002 (SEQ ID NO:84).

FIG. 82 presents the sequence of Gag of clone TV003G15 of isolate C-98TV003 (SEQ ID NO:85).

FIG. 83 presents the sequence of Gag of clone TV004G17 of isolate C-98TV004 (SEQ ID NO:86).

FIG. 84 presents the sequence of Gag of clone TV004G24 of isolate C-98TV004 (SEQ ID NO:87).

FIG. 85 presents the sequence of Gag of clone TV006G11 of isolate C-98TV006 (SEQ ID NO:88).

FIG. 86 presents the sequence of Gag of clone TV006G97 of isolate C-98TV006 (SEQ ID NO:89).

FIG. 87 presents the sequence of Gag of clone TV007G59 of isolate C-98TV009 (SEQ ID NO:90).

FIG. 88 presents the sequence of Gag of clone TV008G65 of isolate C-98TV008 (SEQ ID NO:91).

FIG. 89 presents the sequence of Gag of clone TV008G66 of isolate C-98TV008 (SEQ ID NO:92).

FIG. 90 presents the sequence of Gag of clone TV010G74 of isolate C-98TV010 (SEQ ID NO:93).

FIG. 91 presents the sequence of Gag of clone TV012G34 of isolate C-98TV012 (SEQ ID NO:94).

FIG. 92 presents the sequence of Gag of clone TV012G40 of isolate C-98TV012 (SEQ ID NO:95).

FIG. 93 presents the sequence of Gag of clone TV013G2 of isolate C-98TV013 (SEQ ID NO:96).

FIG. 94 presents the sequence of Gag of clone TV013G15 of isolate C-98TV013 (SEQ ID NO:97).

FIG. 95 presents the sequence of Gag of clone TV014G73 of isolate C-98TV014 (SEQ ID NO:98).

FIG. 96 presents the sequence of Gag of clone TV018G60 of isolate C-98TV018 (SEQ ID NO:99).

FIG. 97 presents the sequence of Gag of clone TV019G20 of isolate C-98TV019 (SEQ ID NO:100).

FIG. 98 presents the sequence of Gag of clone TV019G25 of isolate C-98TV019 (SEQ ID NO:101).

FIGS. 99a, 99a2, 99b and 99c depict alignments of the deduced amino acid sequences of Nef (FIGS. 99a1 and 99a2), Tat (FIG. 99b) and Rev (FIG. 99c) from South African subtype C isolates (TV001 (SEQ ID NO:102 for Nef, SEQ ID NO:206, for Tat and SEQ ID NO:230 for Rev); TV002 (SEQ ID NO:103, SEQ ID NO:207 for Tat and SEQ ID NO:231 for Rev); TV003 (SEQ ID NO:104 for Nef, SEQ ID NO:208 for Tat, SEQ ID NO:232 for Rev); TV004 (SEQ ID NO:105 for Nef, SEQ ID NO:209 for Tat and SEQ ID NO:233 for Rev); TV005 (SEQ ID NO:106 for Nef, SEQ ID NO:210 for Tat and SEQ ID NO:234 for Rev; TV006 (SEQ ID NO:107 for Nef, SEQ ID NO:211 for Tat and SEQ ID NO:235 for Rev); TV007 (SEQ ID NO:108 for Nef, SEQ ID NO:212 for Tat and SEQ ID NO:236 for Rev); TV008 (SEQ ID NO:109 for Nef, SEQ ID NO:213 for Tat and SEQ ID NO:237 for Rev); TV010 (SEQ ID NO: 110 for Nef, SEQ ID NO:214 for Tat and SEQ ID NO:238 for Rev); TV012 (SEQ ID NO:111 for Nef, SEQ ID NO:215 for Tat and SEQ ID NO:239 for Rev); TV013 (SEQ ID NO:112 for Nef, SEQ ID NO:216 for Tat and SEQ ID NO:240 for Rev); TV014 (SEQ ID NO:113 for Nef, SEQ ID NO:217 for Tat and SEQ ID NO:241 for Rev); TV018 (SEQ ID NO:114 for Nef, SEQ ID NO:218 for Tat and SEQ ID NO:242 for Rev); TV019 (SEQ ID NO:115 for Nef, SEQ ID NO:219 for Tat and SEQ ID NO:243 for Rev)) in conjunction with some subtype C reference strains (92BR025 (SEQ ID NO:116 for Nef, SEQ ID NO:220 for Tat and SEQ ID NO:244 for Rev); 301904-Ind (SEQ ID NO:117 for Nef, SEQ ID NO:221 for Tat and SEQ ID NO:245 for Rev); 301905-Ind (SEQ ID NO:118 for Nef, SEQ ID NO:222 for Tat and SEQ ID NO:246 for Rev); 30199-Ind (SEQ ID NO:119 for Nef, SEQ ID NO:223 for Tat and SEQ ID NO:247 for Rev); 96BW16-D14 (SEQ ID NO:120 for Nef, SEQ ID NO:224 for Tat and SEQ ID NO:248 for Rev); 96BW04-09 (SEQ ID NO:121 for Nef, SEQ ID NO:225 for Tat and SEQ ID NO:249 for Rev); 96BW12-10 (SEQ ID NO: 122 for Nef; SEQ ID NO:226 for Tat and SEQ ID NO:250 for Rev); C2220-Eth (SEQ ID NO:123 for Nef, SEQ ID NO:227 for Tat and SEQ ID NO:251 for Rev)) as well as the subtype B reference strain HXB2 (SEQ ID NO:124 for Nef, SEQ ID NO:228 for Tat and SEQ ID NO:252 for Rev). Consensus sequence is shown at the bottom (SEQ ID NO:125 for Nef, SEQ ID NO:229 for Tat and SEQ ID NO:253 for Rev). Dots represent identical residue sequences, dashes represent gaps and asterisks represent stop codons. Significant protein domains and conserved motifs are shaded and labeled.

Figure 100B:
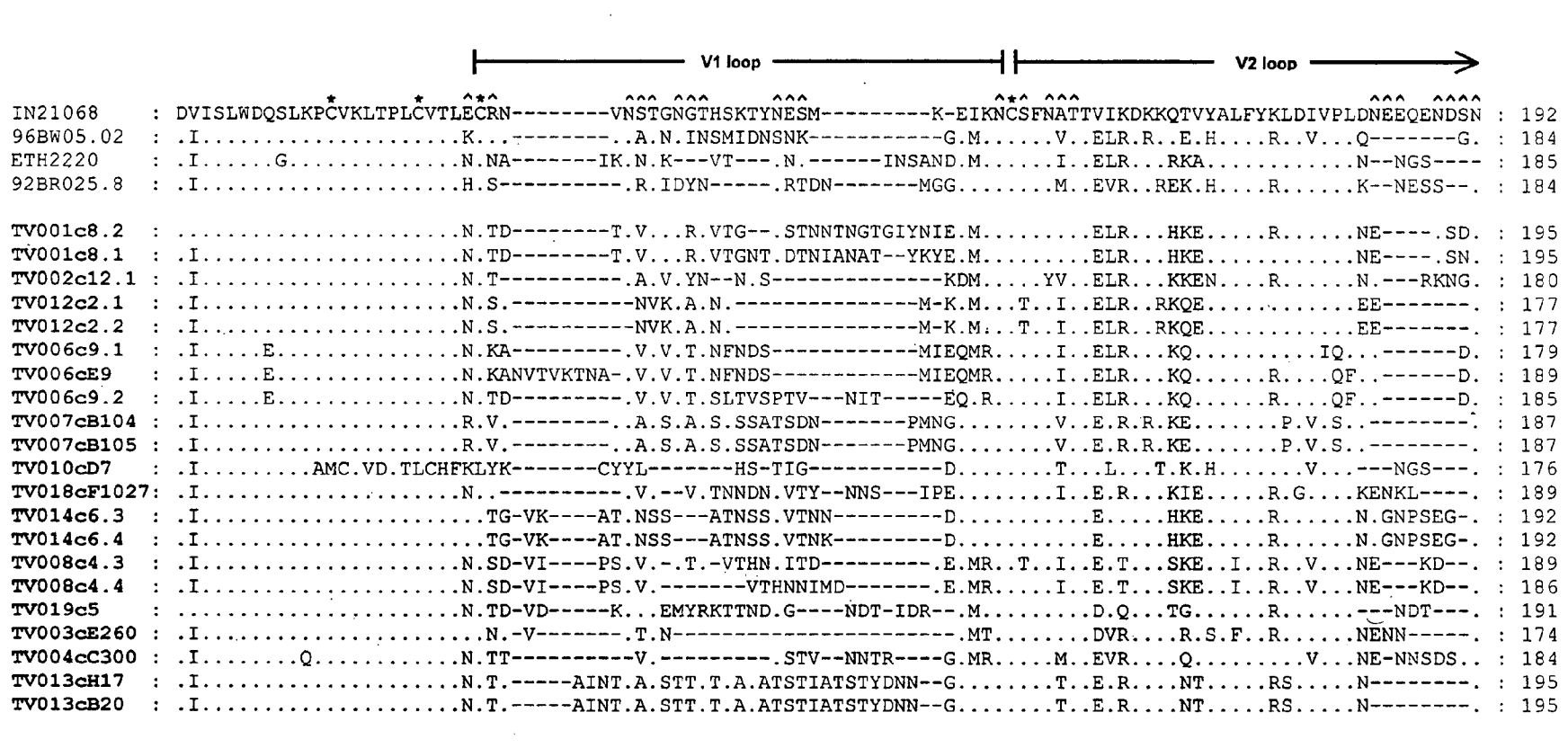
Figure 100C:
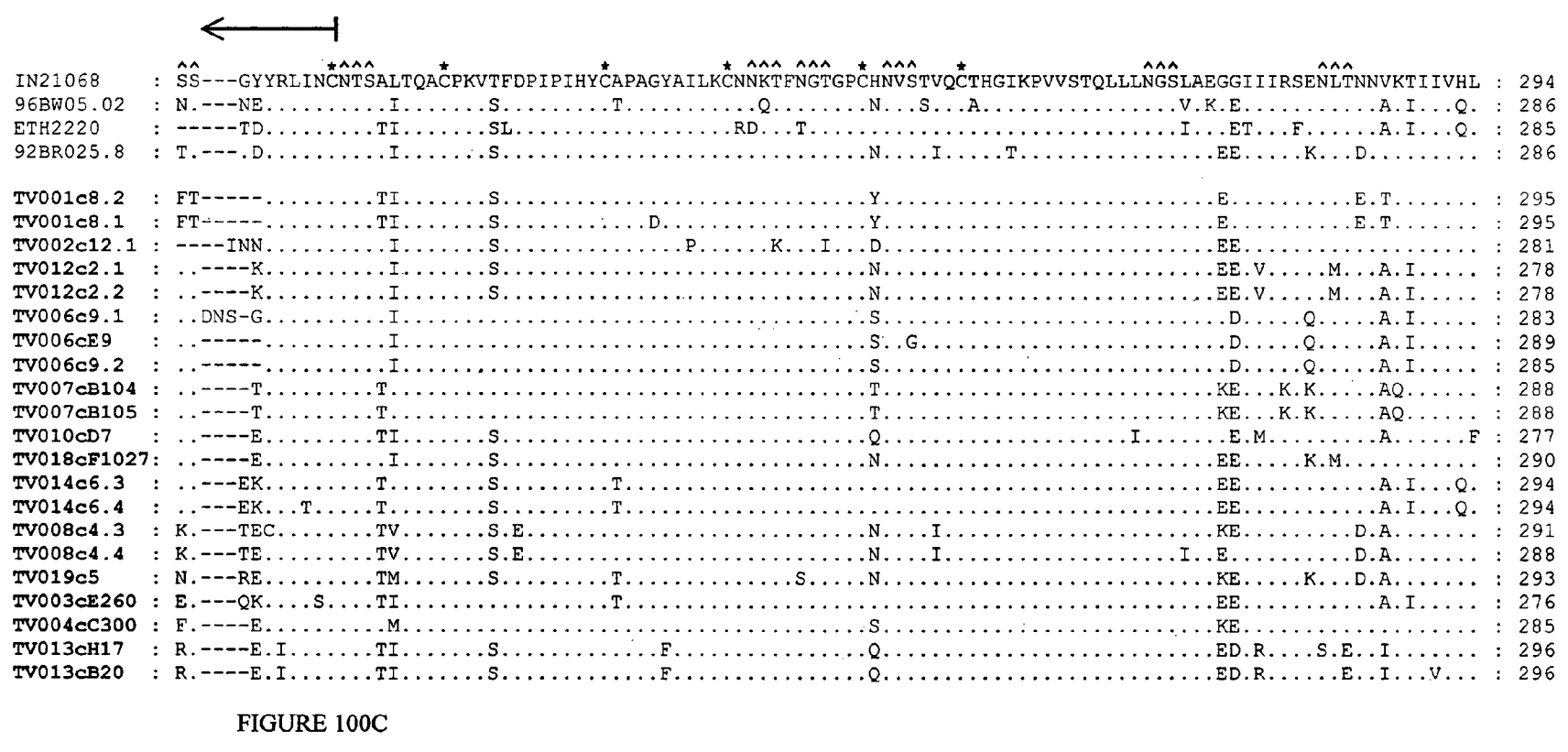
Figure 100E:
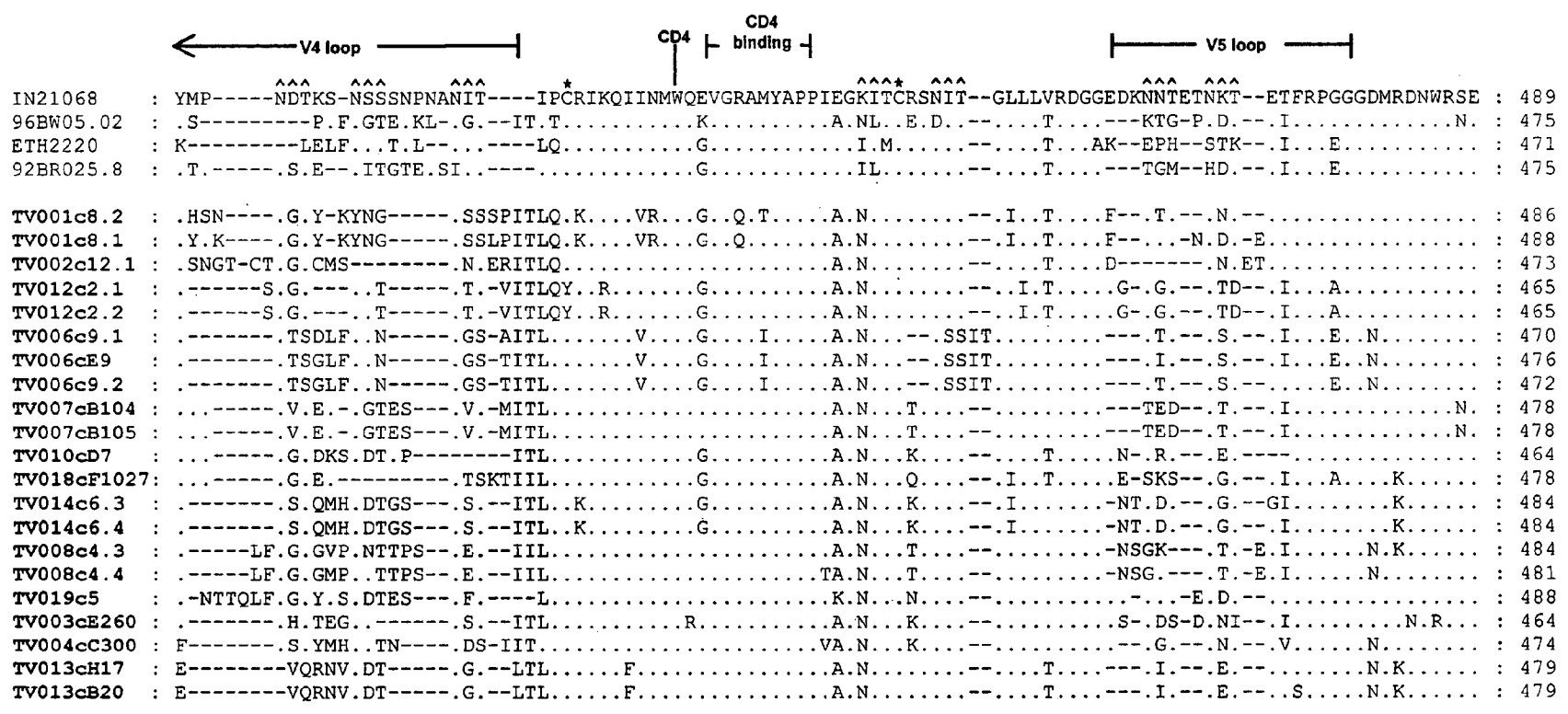
Figure 100G:
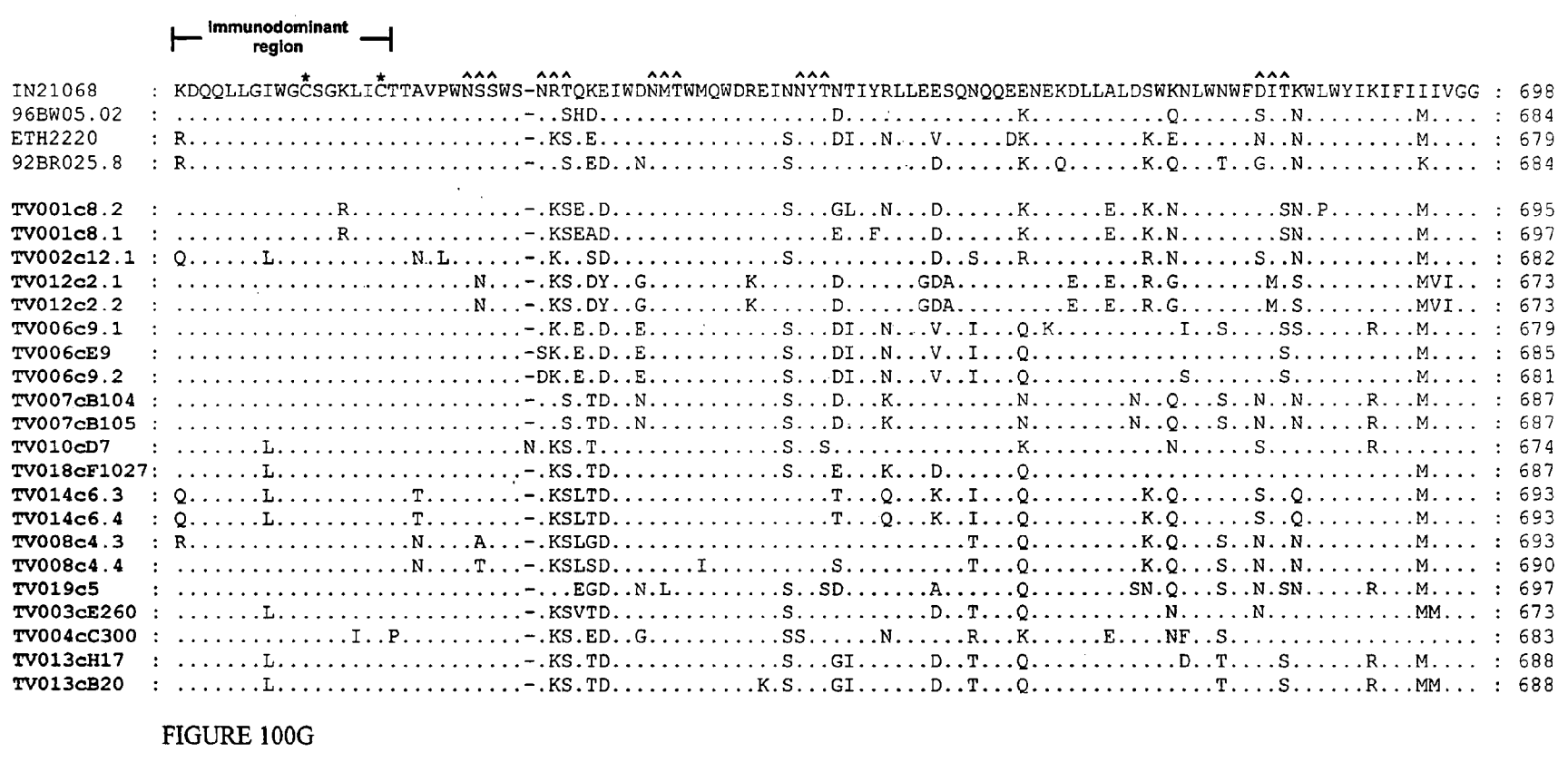

FIGS. 100A–100I depict alignment of the complete Env protein from South African HIV-1 subtype C sequences (TV001c8.2 (SEQ ID NO:126); TV001c8.1 (SEQ ID NO:127); TV002c12.1 (SEQ ID NO:128); TV012c2.1 (SEQ ID NO:129); TV012c2.2 (SEQ ID NO:130); TV006c9.1 (SEQ ID NO:131); TV006cE9 (SEQ ID NO:132); TV006c9.2 (SEQ ID NO:133); TV007cB104 (SEQ ID NO:134); TV007cB105 (SEQ ID NO:135); TV010cD7 (SEQ ID NO:136); TV018cF1027 (SEQ ID NO: 137); TV014c6.3 (SEQ ID NO:138); TV014c6.4 (SEQ ID NO:139); TV008c4.3 (SEQ ID NO:140); TV008c4.4 (SEQ ID NO:141); TV019c5 (SEQ ID NO: 142); TV003cE260 (SEQ ID NO:143); TV004cC300 (SEQ ID NO:144); TV013cH17 (SEQ ID NO:145); TV013cB20 (SEQ ID NO:146)) compared to the subtype C reference strains: IN21068 (SEQ ID NO:147), 96BW05.02 (SEQ ID NO: 148), ETH2220 (SEQ ID NO:149), and 92BR025.8 (SEQ ID NO:150) from the Los Alamos Database. Dots denote sequence identity with the IN21068 sequence, while dashes represent gaps introduced to optimize alignments. Carets indicate possible glycosylation sites present in most of the sequences. Asterisks show positions of cysteine residues. The V1, V2, V3, V4 and V5 variable loops, as well as the signal peptide and CD4 binding residues and sites are indicated above the sequences. Triangles at positions 11, 25 and 35 of the V3 loop indicate amino acids assessed for SI/NSI phenotype.

FIGS. 102A and 102B depict the nucleotide sequence of the 3' region of the clone designated 8_2_TV1 (SEQ ID NO:181).

FIGS. 103A–103E depict the nucleotide sequence of 2_¼_TV12_C_ZA (SEQ ID NO:182).

FIG. 104 depicts the nucleotide sequence of gp140.modTV1.mut1.dV2 (SEQ ID NO:183).

FIG. 105 depicts the nucleotide sequence of gp140mod.TV1.mut2.dV2 (SEQ ID NO:184).

FIG. 106 depicts the nucleotide sequence of gp140mod.TV1.mut3.dV2 (SEQ ID NO:185).

FIG. 107 depicts the nucleotide sequence of gp140mod.TV1.mut4.dV2 (SEQ ID NO:186).

FIG. 108 depicts the nucleotide sequence of gp140.mod.TV1.GM161 (SEQ. ID NO:187).

FIG. 109 depicts the nucleotide sequence of gp140mod.TV1.GM161-195-204 (SEQ ID NO:188).

FIG. 110 depicts the nucleotide sequence of gp140mod.TV1.GM161-204 (SEQ ID NO:189).

FIG. 111 depicts the nucleotide sequence of gp140mod.TV1.GM-V1V2 (SEQ ID NO:190).

FIG. 112 depicts the nucleotide sequence of gp140modC8.2mut7.delV2.Kozmod.Ta (SEQ ID NO:191).

FIG. 113 depicts alignment of the amino acid sequences of various Env cleavage site mutants (translation of gp140mod.TV1.delV2 (SEQ ID NO:192); translation of gp140mod.TV1.mut1.dV2 (SEQ ID NO:193); translation of gp140mod.TV1.mut2.dV2 (SEQ ID NO:194); translation of gp140mod.TV1.mut3.dV2 (SEQ ID NO:195); translation of gp140mod.TV1.mut4.dV2 (SEQ ID NO:196); and translation of gp140mod.TV1.mut7.dV2 (SEQ ID NO:197)). Amino acid changes are shown in bold.

FIG. 114 depicts alignment of amino acid sequences of various Env glycosylation mutants (GM), including translation of gp140mod.TV1 (SEQ ID NO: 198); translation of gp140mod.TV1.GM161 (SEQ ID NO:199); translation of gp140mod.TV1.GM161-204 (SEQ ID NO:200); translation of gp140mod.TV1.GM161-195-204 (SEQ ID NO:201); and translation of gp140mod.TV1.GM-V1V2 (SEQ ID NO:202).

FIG. 115 depicts the nucleotide sequence of Nef-myrD124LLAA (SEQ ID NO:203).

FIG. 116 depicts the amino acid sequence of the protein translated (SEQ ID NO:204) from Nef-myrD124LLAA.

FIG. 117 depicts the nucleotide sequence of gp160mod.TV2 (SEQ ID NO:205).

FIG. 120 is a bar graph depicting comparison of ELISA titers against subtype B and C Env proteins in rabbit sera collected after 3 DNA immunizations and a single protein boost.

Figure 3:
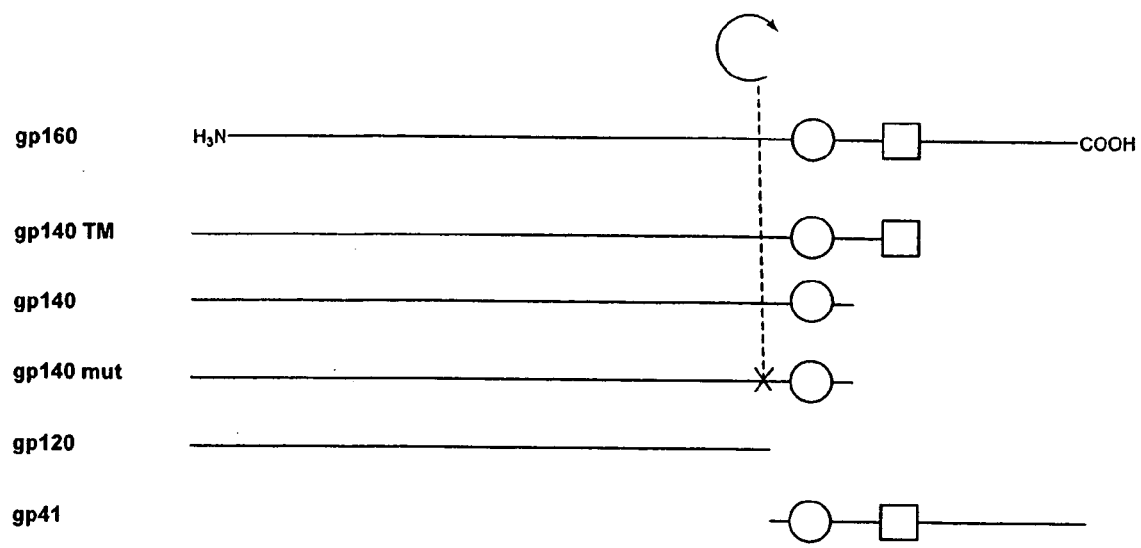
FIG. 3 presents a schematic diagram showing the relationships between the following forms of the HIV Env polypeptide: gp160, gp140, gp120, and gp41.
Figure 4:
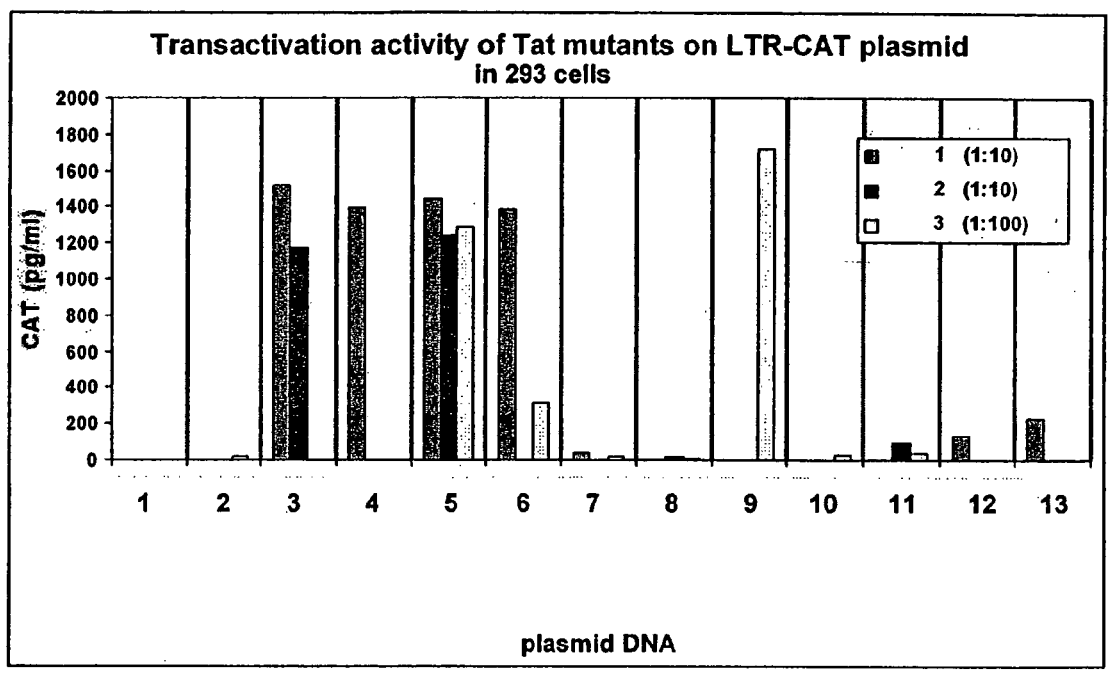
FIG. 4 presents exemplary data concerning transactivation activity of Tat mutants on LTR-CAT plasmid expression in 293 cells.
Figure 5:
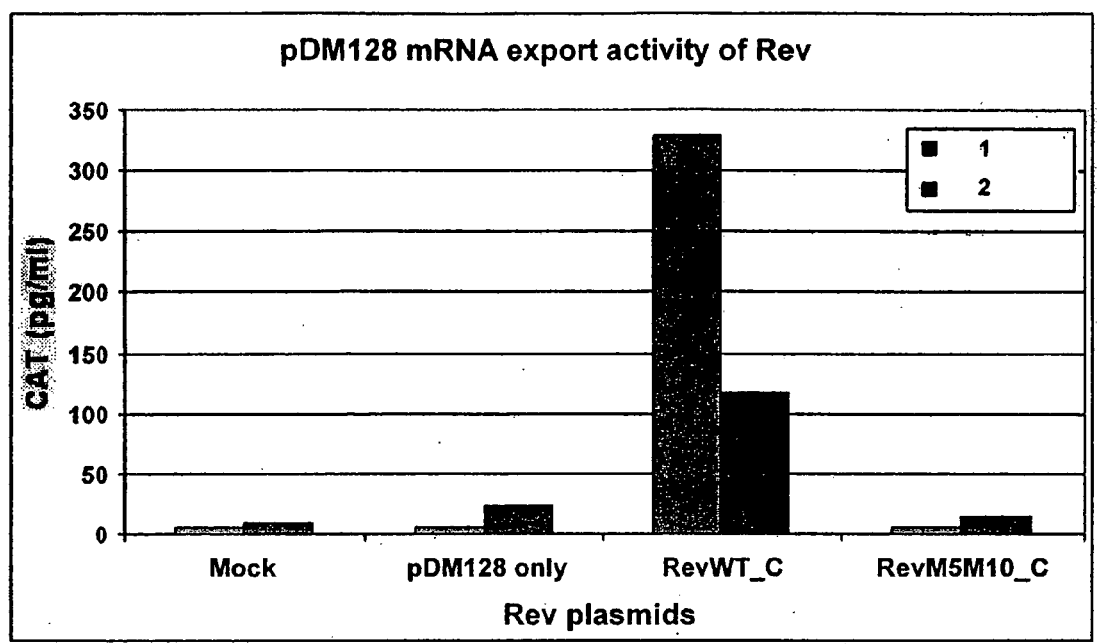
FIG. 5 presents exemplary data concerning export activity of Rev mutants monitored by CAT expression.
Figure 100A:
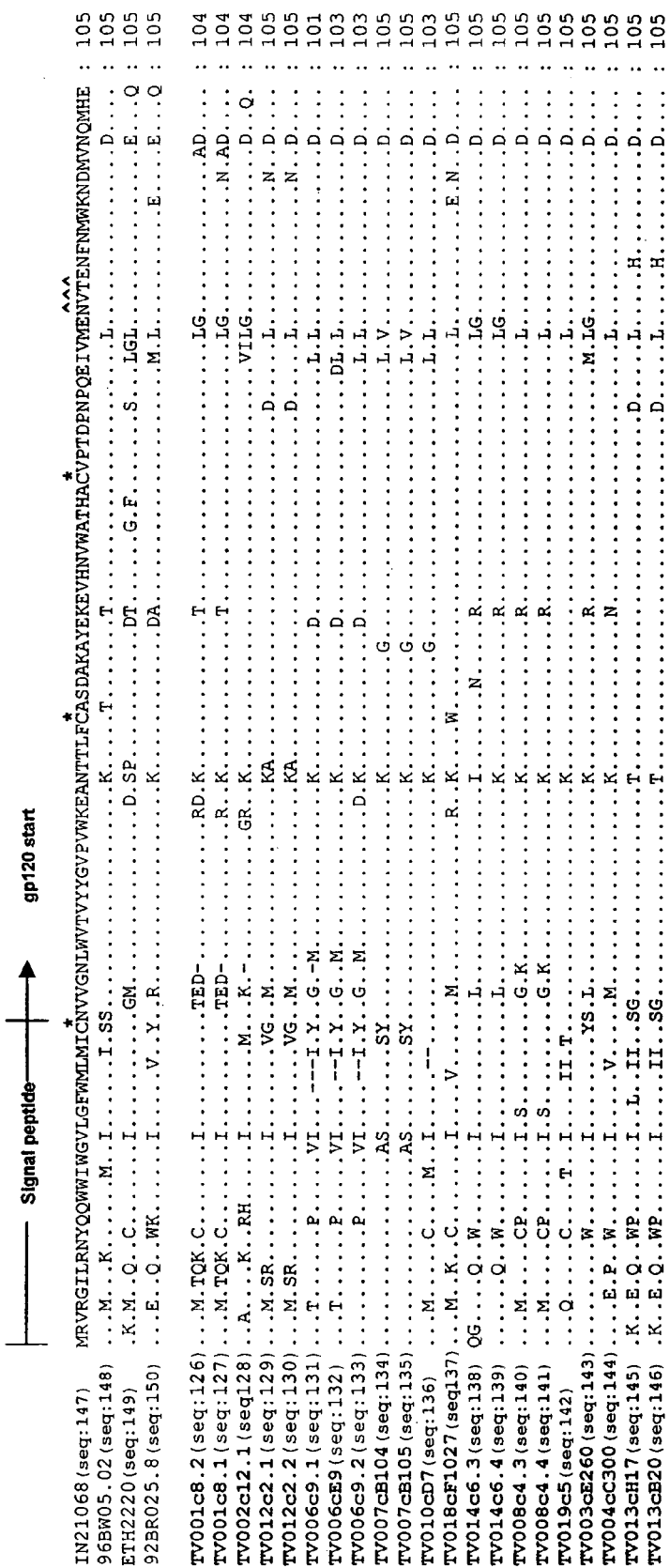
Figure 100D:
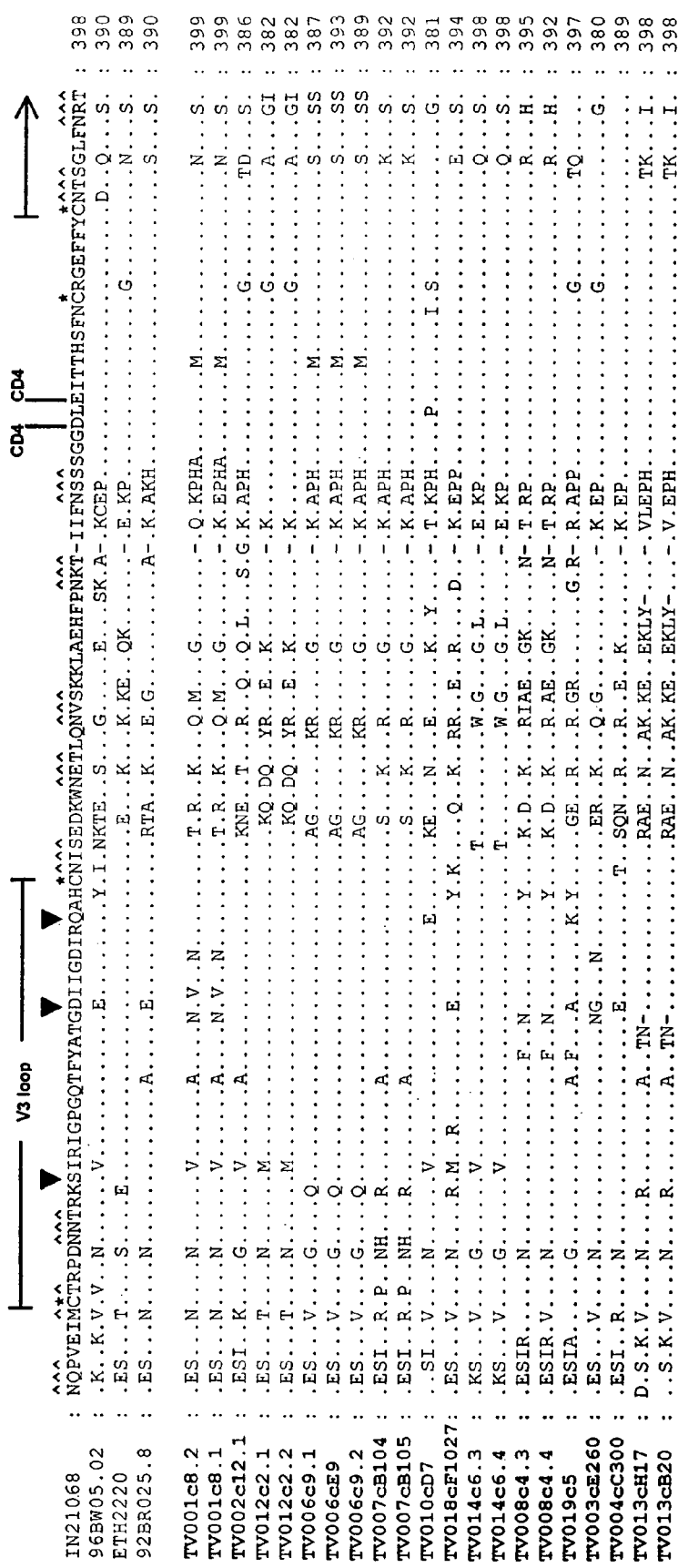
Figure 100F:
Figure 101:
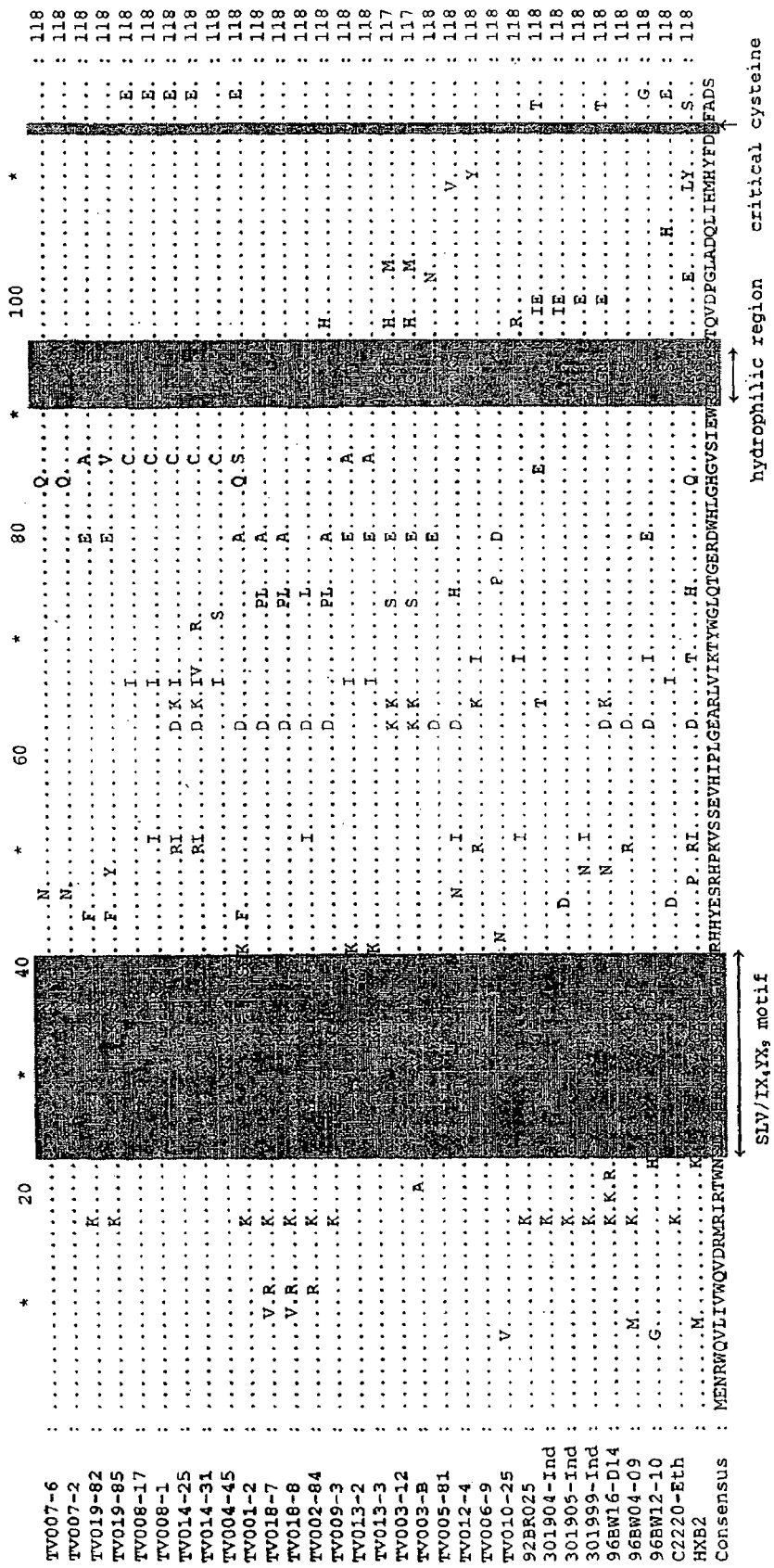
FIG. 101, sheets 1 to 3, depicts alignments of the deduced (A) Vif, (B), Vpr, and (C) Vpu amino acid sequences from South African subtype C isolates (in boldface, TV007-6 (SEQ ID NO:151 for Vif, SEQ ID NO:254 for Vpr and SEQ ID NO:288 for Vpu); TV007-2 (SEQ ID NO:152 for Vif, SEQ ID NO:255 for Vpr and SEQ ID NO:289 for Vpu); TV019-82 (SEQ ID NO:153 for Vif, SEQ ID NO:256 for Vpr and SEQ ID NO:290 for Vpu); TV019-85 (SEQ ID NO:154 for Vif, SEQ ID NO:257 for Vpr and SEQ ID NO:291 for Vpu); TV008-17 (SEQ NO:155 for Vif, SEQ ID NO:258 for Vpr and SEQ ID NO:292 for Vpu); TV008-1 (SEQ ID NO:156 for Vif, SEQ ID NO:259 for Vpr and SEQ ID NO:293 for Vpu); TV014-25 (SEQ ID NO:157 for Vif, SEQ ID NO:260 for Vpr and SEQ ID NO:294 for Vpu); TV014-31 (SEQ ID NO: 158 for Vif, SEQ ID NO:261 for Vpr and SEQ ID NO:295 for Vpu); TV004-45 (SEQ ID NO:159 for Vif, SEQ ID NO:262 for Vpr and SEQ ID NO:296 for Vpu); TV001-2 (SEQ ID NO:160 for Vif, SEQ ID NO:263 for Vpr and SEQ ID NO:297 for Vpu); TV018-7 (SEQ ID NO:286 for Vif, SEQ ID NO:264 for Vpr and SEQ ID NO:298 for Vpu); TV018-8 (SEQ ID NO:161 for Vif, SEQ ID NO:265 for Vpr and SEQ ID NO:299 for Vpu); TV002-84 (SEQ ID NO:162 for Vif, SEQ ID NO:266 for Vpr and SEQ ID NO:300 for Vpu); TV009-3 (SEQ ID NO:163 for Vif, SEQ ID NO:267 for Vpr and SEQ ID NO:301 for Vpu); TV013-2 (SEQ ID NO:164 for Vif, SEQ ID NO:268 for Vpr and SEQ ID NO:302 for Vpu); TV013-3 (SEQ ID NO:165 for Vif, SEQ ID NO:269 for Vpr and SEQ ID NO:303 for Vpu); TV003-12 (SEQ ID NO: 166 for Vif, SEQ ID NO:270 for Vpr and SEQ ID NO:304 for Vpu); TV003-B (SEQ ID NO:167 for Vif, SEQ ID NO:271 for Vpr and SEQ ID NO:305 for Vpu); TV005-81 (SEQ ID NO:168 for Vif, SEQ ID NO:272 for Vpr and SEQ ID NO:306 for Vpu); TV012-4 (SEQ ID NO:169 for Vif, SEQ ID NO:273 for Vpr and SEQ ID NO:307 for Vpu); TV006-9 (SEQ ID NO:170 for Vif, SEQ ID NO:274 for Vpr and SEQ ID NO:308 for Vpu); TV010-25 (SEQ ID NO:171 for Vif, SEQ ID NO:275 for Vpr and SEQ ID NO:309 for Vpu) in conjunction with some subtype C reference strains 92BR025 (SEQ ID NO:172 for Vif, SEQ ID NO:276 for Vpr and SEQ ID NO:310 for Vpu); 301904-Ind (SEQ ID NO:173 for Vif, SEQ ID NO:277 for Vpr and SEQ ID NO:311 for Vpu); 301905-Ind (SEQ ID NO:174 for Vif, SEQ ID NO:278 for Vpr and SEQ ID NO:312 for Vpu); 30199-Ind (SEQ ID NO:175 for Vif, SEQ ID NO:279 for Vpr and SEQ ID NO:313 for Vpu); 96BW16-D14 (SEQ ID NO:176 for Vif, SEQ ID NO:280 for Vpr and SEQ ID NO:314 for Vpu); 96BW04-09 (SEQ ID NO:177 for Vif, SEQ ID NO:281 for Vpr and SEQ ID NO:315 for Vpu); 96BW12-10 (SEQ ID NO:178 for Vif, SEQ ID NO:282 for Vpr and SEQ ID NO:316 for Vpu); C2220-Eth (SEQ ID NO:179 for Vif, SEQ ID NO:283 for Vpr and SEQ ID NO:317 for Vpu)) as well as HXB2 (SEQ ID NO:180 for Vif, SEQ ID NO:284 for Vpr and SEQ ID NO:318 for Vpu). Consensus sequences are shown as SEQ ID NO:287 for Vif, SEQ ID NO:285 for Vpr and SEQ ID NO:319 for Vpu.
Figure 101:
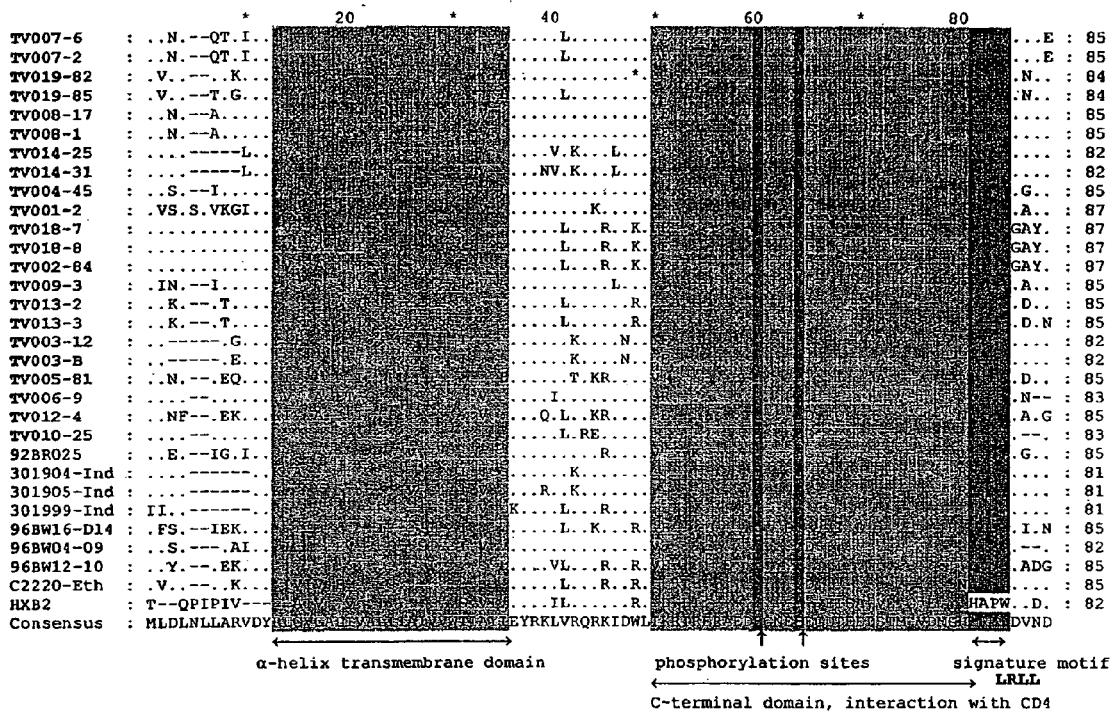

FIG. 121 presents data of neutralizing antibody responses against subtype B SF162 EnvdV2 strain in rabbits immunized with subtype C TV1 Env in a DNA prime protein boost regimen.

FIG. 122 presents data of neutralizing antibody responses against subtype C primary strains, TV1 and TV2 in 5.25 reporter cell assay after a single protein boost.

FIG. 123 presents data of neutralizing antibody responses against subtype C, TV1 and Du174, and subtype B, SF162 after a single protein boost (as measured by Duke PBMC assay).

DETAILED DESCRIPTION OF THE INVENTION

The practice of the present invention will employ, unless otherwise indicated, conventional methods of chemistry, biochemistry, molecular biology, immunology and pharmacology, within the skill of the art. Such techniques are explained fully in the literature. See, e.g., *Remington's Pharmaceutical Sciences,* 18th Edition (Easton, Pa.: Mack Publishing Company, 1990); *Methods In Enzymology* (S. Colowick and N. Kaplan, eds., Academic Press, Inc.); and *Handbook of Experimental Immunology*, Vols. I–IV (D. M. Weir and C. C. Blackwell, eds., 1986, Blackwell Scientific Publications); Sambrook, et al., *Molecular Cloning: A Laboratory Manual* (2nd Edition, 1989); *Short Protocols in Molecular Biology,* 4th ed. (Ausubel et al. eds., 1999, John Wiley & Sons); *Molecular Biology Techniques: An Intensive Laboratory Course,* (Ream et al., eds., 1998, Academic Press); PCR (*Introduction to Biotechniques Series*), 2nd ed. (Newton & Graham eds., 1997, Springer Verlag).

All publications, patents and patent applications cited herein, whether supra or infra, are hereby incorporated by reference in their entirety.

As used in this specification, the singular forms "a," "an" and "the" include plural references unless the content clearly dictates otherwise. Thus, for example, reference to "an antigen" includes a mixture of two or more such agents.

1. Definitions

In describing the present invention, the following terms will be employed, and are intended to be defined as indicated below.

"Synthetic" sequences, as used herein, refers to HIV polypeptide-encoding polynucleotides whose expression has been modified as described herein, for example, by codon substitution, altered activities, and/or inactivation of inhibitory sequences. "Wild-type" or "native" sequences, as used herein, refers to polypeptide encoding sequences that are essentially as they are found in nature, e.g., Gag, Pol, Vif, Vpr, Tat, Rev, Vpu, Env and/or Nef encoding sequences as found in HIV isolates, e.g., SF162, SF2, AF110965, AF110967, AF110968, AF110975, 8_5_TV1_C.ZA, 8_2_TV1_C.ZA or 12-5_1_TV2_C.ZA. The various regions of the HIV genome are shown in Table A, with numbering relative to 8_5_TV1_C.ZA (FIGS. 1A–1D). Thus, the term "Pol" refers to one or more of the following polypeptides: polymerase (p6Pol); protease (prot); reverse transcriptase (p66RT or RT); RNAseH (p15RNAseH); and/or integrase (p31Int or Int). Identification of gene regions for any selected HIV isolate can be performed by one of ordinary skill in the art based on the teachings presented herein and the information known in the art, for example, by performing alignments relative to 8_5_TV1_C.ZA (FIGS. 1A–1D) or alignment to other known HIV isolates, for example, Subtype B isolates with gene regions (e.g., SF2, GenBank Accession number K02007; SF162, GenBank Accession Number M38428, both herein incorporated by reference) and Subtype C isolates with gene regions (e.g., GenBank Accession Number AF110965 and GenBank Accession Number AF110975, both herein incorporated by reference).

As used herein, the term "virus-like particle" or "VLP" refers to a nonreplicating, viral shell, derived from any of several viruses discussed further below. VLPs are generally composed of one or more viral proteins, such as, but not limited to those proteins referred to as capsid, coat, shell, surface and/or envelope proteins, or particle-forming polypeptides derived from these proteins. VLPs can form spontaneously upon recombinant expression of the protein in an appropriate expression system. Methods for producing particular VLPs are known in the art and discussed more fully below. The presence of VLPs following recombinant expression of viral proteins can be detected using conventional techniques known in the art, such as by electron microscopy, X-ray crystallography, and the like. See, e.g., Baker et al., *Biophys. J.* (1991) 60:1445–1456; Hagensee et al., *J. Virol.* (1994) 68:4503–4505. For example, VLPs can be isolated by density gradient centrifugation and/or identified by characteristic density banding. Alternatively, cryoelectron microscopy can be performed on vitrified aqueous samples of the VLP preparation in question, and images recorded under appropriate exposure conditions.

By "particle-forming polypeptide" derived from a particular viral protein is meant a full-length or near full-length viral protein, as well as a fragment thereof, or a viral protein with internal deletions, which has the ability to form VLPs under conditions that favor VLP formation. Accordingly, the polypeptide may comprise the full-length sequence, fragments, truncated and partial sequences, as well as analogs and precursor forms of the reference molecule. The term therefore intends deletions, additions and substitutions to the sequence, so long as the polypeptide retains the ability to form a VLP. Thus, the term includes natural variations of the specified polypeptide since variations in coat proteins often occur between viral isolates. The term also includes deletions, additions and substitutions that do not naturally occur in the reference protein, so long as the protein retains the ability to form a VLP. Preferred substitutions are those which are conservative in nature, i.e., those substitutions that take place within a family of amino acids that are related in their side chains. Specifically, amino acids are generally divided into four families: (1) acidic—aspartate and glutamate; (2) basic—lysine, arginine, histidine; (3) non-polar—alanine, valine, leucine, isoleucine, proline, phenylalanine, methionine, tryptophan; and (4) uncharged polar—glycine, asparagine, glutamine, cystine, serine threonine, tyrosine. Phenylalanine, tryptophan, and tyrosine are sometimes classified as aromatic amino acids.

The term "HIV polypeptide" refers to any amino acid sequence that exhibits sequence homology to native HIV polypeptides (e.g., Gag, Env, Prot, Pol, RT, Int, vif, vpr, vpu, tat, rev, nef and/or combinations thereof) and/or which is functional. Non-limiting examples of functions that may be exhibited by HIV polypeptides include, use as immunogens (e.g., to generate a humoral and/or cellular immune response), use in diagnostics (e.g, bound by suitable antibodies for use in ELISAs or other immunoassays) and/or polypeptides which exhibit one or more biological activities associated with the wild type or synthetic HIV polypeptide. For example, as used herein, the term "Gag polypeptide" may refer to a polypeptide that is bound by one or more anti-Gag antibodies; elicits a humoral and/or cellular immune response; and/or exhibits the ability to form particles.

An "antigen" refers to a molecule containing one or more epitopes (either linear, conformational or both) that will stimulate a host's immune system to make a humoral and/or cellular antigen-specific response. The term is used interchangeably with the term "immunogen." Normally, a B-cell epitope will include at least about 5 amino acids but can be as small as 3–4 amino acids. A T-cell epitope, such as a CTL epitope, will include at least about 7–9 amino acids, and a helper T-cell epitope at least about 12–20 amino acids. Normally, an epitope will include between about 7 and 15 amino acids, such as, 9, 10, 12 or 15 amino acids. The term "antigen" denotes both subunit antigens, (i.e., antigens which are separate and discrete from a whole organism with which the antigen is associated in nature), as well as, killed, attenuated or inactivated bacteria, viruses, fungi, parasites or other microbes. Antibodies such as anti-idiotype antibodies, or fragments thereof, and synthetic peptide mimotopes, which can mimic an antigen or antigenic determinant, are also captured under the definition of antigen as used herein. Similarly, an oligonucleotide or polynucleotide which expresses an antigen or antigenic determinant in vivo, such as in gene therapy and DNA immunization applications, is also included in the definition of antigen herein.

For purposes of the present invention, antigens can be derived from any of several known viruses, bacteria, parasites and fungi, as described more fully below. The term also intends any of the various tumor antigens. Furthermore, for purposes of the present invention, an "antigen" refers to a protein which includes modifications, such as deletions, additions and substitutions (generally conservative in nature), to the native sequence, so long as the protein maintains the ability to elicit an immunological response, as defined herein. These modifications may be deliberate, as through site-directed mutagenesis, or may be accidental, such as through mutations of hosts which produce the antigens.

An "immunological response" to an antigen or composition is the development in a subject of a humoral and/or a cellular immune response to an antigen present in the composition of interest. For purposes of the present invention, a "humoral immune response" refers to an immune response mediated by antibody molecules, while a "cellular immune response" is one mediated by T-lymphocytes and/or other white blood cells. One important aspect of cellular immunity involves an antigen-specific response by cytolytic T-cells ("CTL"s). CTLs have specificity for peptide antigens that are presented in association with proteins encoded by the major histocompatibility complex (MHC) and expressed on the surfaces of cells. CTLs help induce and promote the destruction of intracellular microbes, or the lysis of cells infected with such microbes. Another aspect of cellular immunity involves an antigen-specific response by helper T-cells. Helper T-cells act to help stimulate the function, and focus the activity of, nonspecific effector cells against cells displaying peptide antigens in association with MHC molecules on their surface. A "cellular immune response" also refers to the production of cytokines, chemokines and other such molecules produced by activated T-cells and/or other white blood cells, including those derived from CD4+ and CD8+ T-cells.

A composition or vaccine that elicits a cellular immune response may serve to sensitize a vertebrate subject by the presentation of antigen in association with MHC molecules at the cell surface. The cell-mediated immune response is directed at, or near, cells presenting antigen at their surface. In addition, antigen-specific T-lymphocytes can be generated to allow for the future protection of an immunized host.

The ability of a particular antigen to stimulate a cell-mediated immunological response may be determined by a number of assays, such as by lymphoproliferation (lymphocyte activation) assays, CTL cytotoxic cell assays, or by assaying for T-lymphocytes specific for the antigen in a sensitized subject. Such assays are well known in the art. See, e.g., Erickson et al., *J. Immunol.* (1993) 151:4189–4199; Doe et al., *Eur. J. Immunol.* (1994) 24:2369–2376. Recent methods of measuring cell-mediated immune response include measurement of intracellular cytokines or cytokine secretion by T-cell populations, or by measurement of epitope specific T-cells (e.g., by the tetramer technique)(reviewed by McMichael, A. J., and O'Callaghan, C. A., *J. Exp. Med.* 187(9)1367–1371, 1998; Mcheyzer-Williams, M. G., et al, *Immunol. Rev.* 150:5–21, 1996; Lalvani, A., et al, *J. Exp. Med.* 186:859–865, 1997).

Thus, an immunological response as used herein may be one which stimulates the production of CTLs, and/or the production or activation of helper T-cells. The antigen of interest may also elicit an antibody-mediated immune response. Hence, an immunological response may include one or more of the following effects: the production of antibodies by B-cells; and/or the activation of suppressor T-cells and/or γδ T-cells directed specifically to an antigen or antigens present in the composition or vaccine of interest. These responses may serve to neutralize infectivity, and/or mediate antibody-complement, or antibody dependent cell cytotoxicity (ADCC) to provide protection to an immunized host. Such responses can be determined using standard immunoassays and neutralization assays, well known in the art.

An "immunogenic composition" is a composition that comprises an antigenic molecule where administration of the composition to a subject results in the development in the subject of a humoral and/or a cellular immune response to the antigenic molecule of interest. The immunogenic composition can be introduced directly into a recipient subject, such as by injection, inhalation, oral, intranasal and mucosal (e.g., intra-rectally or intra-vaginally) administration.

By "subunit vaccine" is meant a vaccine composition which includes one or more selected antigens but not all antigens, derived from or homologous to, an antigen from a pathogen of interest such as from a virus, bacterium, parasite or fungus. Such a composition is substantially free of intact pathogen cells or pathogenic particles, or the lysate of such cells or particles. Thus, a "subunit vaccine" can be prepared from at least partially purified (preferably substantially purified) immunogenic polypeptides from the pathogen, or analogs thereof. The method of obtaining an antigen included in the subunit vaccine can thus include standard purification techniques, recombinant production, or synthetic production.

"Substantially purified" general refers to isolation of a substance (compound, polynucleotide, protein, polypeptide, polypeptide composition) such that the substance comprises the majority percent of the sample in which it resides. Typically in a sample a substantially purified component comprises 50%, preferably 80%–85%, more preferably 90–95% of the sample. Techniques for purifying polynucleotides and polypeptides of interest are well-known in the art and include, for example, ion-exchange chromatography, affinity chromatography and sedimentation according to density.

A "coding sequence" or a sequence which "encodes" a selected polypeptide, is a nucleic acid molecule which is transcribed (in the case of DNA) and translated (in the case of mRNA) into a polypeptide in vivo when placed under the control of appropriate regulatory sequences (or "control elements"). The boundaries of the coding sequence are determined by a start codon at the 5' (amino) terminus and a translation stop codon at the 3' (carboxy) terminus. A coding sequence can include, but is not limited to, cDNA from viral, procaryotic or eucaryotic mRNA, genomic DNA sequences from viral or procaryotic DNA, and even synthetic DNA sequences. A transcription termination sequence such as a stop codon may be located 3' to the coding sequence.

Typical "control elements", include, but are not limited to, transcription promoters, transcription enhancer elements, transcription termination signals, polyadenylation sequences (located 3' to the translation stop codon), sequences for optimization of initiation of translation (located 5' to the coding sequence), and translation termination sequences.

For example, the sequences and/or vectors described herein may also include one or more additional sequences that may optimize translation and/or termination including, but not limited to, a Kozak sequence (e.g., GCCACC, nucleotides 1 to 6 of SEQ ID NO:191) placed in front (5') of the ATG of the codon-optimized wild-type leader or any other suitable leader sequence (e.g., tpa1, tpa2, wtLnat (native wild-type leader)) or a termination sequence (e.g., TAA or, preferably, TAAA, nucleotides 1978 to 1981 of SEQ ID NO:191) placed after (3') the coding sequence.

A "polynucleotide coding sequence" or a sequence which "encodes" a selected polypeptide, is a nucleic acid molecule which is transcribed (in the case of DNA) and translated (in the case of mRNA) into a polypeptide in vivo when placed under the control of appropriate regulatory sequences (or "control elements"). The boundaries of the coding sequence are determined by a start codon, for example, at or near the 5' terminus and a translation stop codon, for example, at or near the 3' terminus. Exemplary coding sequences are the modified viral polypeptide-coding sequences of the present invention. The coding regions of the polynucleotide sequences of the present invention are identifiable by one of skill in the art and may, for example, be easily identified by performing translations of all three frames of the polynucleotide and identifying the frame corresponding to the encoded polypeptide, for example, a synthetic nef polynucleotide of the present invention encodes a nef-derived polypeptide. A transcription termination sequence may be located 3' to the coding sequence. Typical "control elements", include, but are not limited to, transcription regulators, such as promoters, transcription enhancer elements, transcription termination signals, and polyadenylation sequences; and translation regulators, such as sequences for optimization of initiation of translation, e.g., Shine-Dalgarno (ribosome binding site) sequences, Kozak sequences (i.e., sequences for the optimization of translation, located, for example, 5' to the coding sequence), leader sequences, translation initiation codon (e.g., ATG), and translation termination sequences. In certain embodiments, one or more translation regulation or initiation sequences (e.g., the leader sequence) are derived from wild-type translation initiation sequences, i.e., sequences that regulate translation of the coding region in their native state. Wild-type leader sequences that have been modified, using the methods described herein, also find use in the present invention. Promoters can include inducible promoters (where expression of a polynucleotide sequence operably linked to the promoter is induced by an analyte, cofactor, regulatory protein, etc.), repressible promoters (where expression of a polynucleotide sequence operably linked to the promoter is induced by an analyte, cofactor, regulatory protein, etc.), and constitutive promoters.

A "nucleic acid" molecule can include, but is not limited to, procaryotic sequences, eucaryotic mRNA, cDNA from eucaryotic mRNA, genomic DNA sequences from eucaryotic (e.g., mammalian) DNA, and even synthetic DNA sequences. The term also captures sequences that include any of the known base analogs of DNA and RNA.

"Operably linked" refers to an arrangement of elements wherein the components so described are configured so as to perform their usual function. Thus, a given promoter operably linked to a coding sequence is capable of effecting the expression of the coding sequence when the proper enzymes are present. The promoter need not be contiguous with the coding sequence, so long as it functions to direct the expression thereof. Thus, for example, intervening untranslated yet transcribed sequences can be present between the promoter sequence and the coding sequence and the promoter sequence can still be considered "operably linked" to the coding sequence.

"Recombinant" as used herein to describe a nucleic acid molecule means a polynucleotide of genomic, cDNA, semi-synthetic, or synthetic origin which, by virtue of its origin or manipulation: (1) is not associated with all or a portion of the polynucleotide with which it is associated in nature; and/or (2) is linked to a polynucleotide other than that to which it is linked in nature. The term "recombinant" as used with respect to a protein or polypeptide means a polypeptide produced by expression of a recombinant polynucleotide. "Recombinant host cells," "host cells," "cells," "cell lines," "cell cultures," and other such terms denoting procaryotic microorganisms or eucaryotic cell lines cultured as unicellular entities, are used inter-changeably, and refer to cells which can be, or have been, used as recipients for recombinant vectors or other transfer DNA, and include the progeny of the original cell which has been transfected. It is understood that the progeny of a single parental cell may not necessarily be completely identical in morphology or in genomic or total DNA complement to the original parent, due to accidental or deliberate mutation. Progeny of the parental cell which are sufficiently similar to the parent to be characterized by the relevant property, such as the presence of a nucleotide sequence encoding a desired peptide, are included in the progeny intended by this definition, and are covered by the above terms.

Techniques for determining amino acid sequence "similarity" are well known in the art. In general, "similarity" means the exact amino acid to amino acid comparison of two or more polypeptides at the appropriate place, where amino acids are identical or possess similar chemical and/or physical properties such as charge or hydrophobicity. A so-termed "percent similarity" then can be determined between the compared polypeptide sequences. Techniques for determining nucleic acid and amino acid sequence identity also are well known in the art and include determining the nucleotide sequence of the mRNA for that gene (usually via a cDNA intermediate) and determining the amino acid sequence encoded thereby, and comparing this to a second amino acid sequence. In general, "identity" refers to an exact nucleotide to nucleotide or amino acid to amino acid correspondence of two polynucleotides or polypeptide sequences, respectively.

Two or more polynucleotide sequences can be compared by determining their "percent identity." Two or more amino acid sequences likewise can be compared by determining their "percent identity." The percent identity of two sequences, whether nucleic acid or peptide sequences, is generally described as the number of exact matches between two aligned sequences divided by the length of the shorter sequence and multiplied by 100. An approximate alignment for nucleic acid sequences is provided by the local homology algorithm of Smith and Waterman, Advances in Applied Mathematics 2:482–489 (1981). This algorithm can be extended to use with peptide sequences using the scoring matrix developed by Dayhoff, Atlas of Protein Sequences and Structure, M. O. Dayhoff ed., 5 suppl. 3:353–358, National Biomedical Research Foundation, Washington, D.C., USA, and normalized by Gribskov, Nucl.

Acids Res. 14(6):6745–6763 (1986). An implementation of this algorithm for nucleic acid and peptide sequences is provided by the Genetics Computer Group (Madison, Wis.) in their BestFit utility application. The default parameters for this method are described in the Wisconsin Sequence Analysis Package Program Manual, Version 8 (1995) (available from Genetics Computer Group, Madison, Wis.). Other equally suitable programs for calculating the percent identity or similarity between sequences are generally known in the art.

For example, percent identity of a particular nucleotide sequence to a reference sequence can be determined using the homology algorithm of Smith and Waterman with a default scoring table and a gap penalty of six nucleotide positions. Another method of establishing percent identity in the context of the present invention is to use the MPSRCH package of programs copyrighted by the University of Edinburgh, developed by John F. Collins and Shane S. Sturrok, and distributed by IntelliGenetics, Inc. (Mountain View, Calif.). From this suite of packages, the Smith-Waterman algorithm can be employed where default parameters are used for the scoring table (for example, gap open penalty of 12, gap extension penalty of one, and a gap of six).

From the data generated, the "Match" value reflects "sequence identity." Other suitable programs for calculating the percent identity or similarity between sequences are generally known in the art, such as the alignment program BLAST, which can also be used with default parameters. For example, BLASTN and BLASTP can be used with the following default parameters: genetic code=standard; filter=none; strand=both; cutoff=60; expect=10; Matrix=BLOSUM62; Descriptions=50 sequences; sort by=HIGH SCORE; Databases=non-redundant, GenBank+EMBL+DDBJ+PDB+GenBank CDS translations+Swiss protein+Spupdate+PIR. Details of these programs can be found at the following internet address: http://www.ncbi.nlm.gov/cgi-bin/BLAST.

One of skill in the art can readily determine the proper search parameters to use for a given sequence, exemplary preferred Smith Waterman based parameters are presented above. For example, the search parameters may vary based on the size of the sequence in question. Thus, for the polynucleotide sequences of the present invention the length of the polynucleotide sequence disclosed herein is searched against a selected database and compared to sequences of essentially the same length to determine percent identity. For example, a representative embodiment of the present invention would include an isolated polynucleotide comprising X contiguous nucleotides, wherein (i) the X contiguous nucleotides have at least about a selected level of percent identity relative to Y contiguous nucleotides of one or more of the sequences described herein (e.g., in Table C) or fragment thereof, and (ii) for search purposes X equals Y, wherein Y is a selected reference polynucleotide of defined length (for example, a length of from 15 nucleotides up to the number of nucleotides present in a selected full-length sequence).

The sequences of the present invention can include fragments of the sequences, for example, from about 15 nucleotides up to the number of nucleotides present in the full-length sequences described herein (e.g., see the Figures), including all integer values falling within the above-described range. For example, fragments of the polynucleotide sequences of the present invention may be 30–60 nucleotides, 60–120 nucleotides, 120–240 nucleotides, 240–480 nucleotides, 480–1000 nucleotides, and all integer values therebetween.

The synthetic expression cassettes (and purified polynucleotides) of the present invention include related polynucleotide sequences having about 80% to 100%, greater than 80–85%, preferably greater than 90–92%, more preferably greater than 95%, and most preferably greater than 98% up to 100% (including all integer values falling within these described ranges) sequence identity to the synthetic expression cassette and/or polynucleotide sequences disclosed herein (for example, to the sequences of the present invention) when the sequences of the present invention are used as the query sequence against, for example, a database of sequences.

Two nucleic acid fragments are considered to "selectively hybridize" as described herein. The degree of sequence identity between two nucleic acid molecules affects the efficiency and strength of hybridization events between such molecules. A partially identical nucleic acid sequence will at least partially inhibit a completely identical sequence from hybridizing to a target molecule. Inhibition of hybridization of the completely identical sequence can be assessed using hybridization assays that are well known in the art (e.g., Southern blot, Northern blot, solution hybridization, or the like, see Sambrook, et al., supra or Ausubel et al., supra). Such assays can be conducted using varying degrees of selectivity, for example, using conditions varying from low to high stringency. If conditions of low stringency are employed, the absence of non-specific binding can be assessed using a secondary probe that lacks even a partial degree of sequence identity (for example, a probe having less than about 30% sequence identity with the target molecule), such that, in the absence of non-specific binding events, the secondary probe will not hybridize to the target.

When utilizing a hybridization-based detection system, a nucleic acid probe is chosen that is complementary to a target nucleic acid sequence, and then by selection of appropriate conditions the probe and the target sequence "selectively hybridize," or bind, to each other to form a hybrid molecule. A nucleic acid molecule that is capable of hybridizing selectively to a target sequence under "moderately stringent" typically hybridizes under conditions that allow detection of a target nucleic acid sequence of at least about 10–14 nucleotides in length having at least approximately 70% sequence identity with the sequence of the selected nucleic acid probe. Stringent hybridization conditions typically allow detection of target nucleic acid sequences of at least about 10–14 nucleotides in length having a sequence identity of greater than about 90–95% with the sequence of the selected nucleic acid probe. Hybridization conditions useful for probe/target hybridization where the probe and target have a specific degree of sequence identity, can be determined as is known in the art (see, for example, *Nucleic Acid Hybridization: A Practical Approach*, editors B. D. Hames and S. J. Higgins, (1985) Oxford; Washington, D.C.; IRL Press).

With respect to stringency conditions for hybridization, it is well known in the art that numerous equivalent conditions can be employed to establish a particular stringency by varying, for example, the following factors: the length and nature of probe and target sequences, base composition of the various sequences, concentrations of salts and other hybridization solution components, the presence or absence of blocking agents in the hybridization solutions (e.g., formamide, dextran sulfate, and polyethylene glycol), hybridization reaction temperature and time parameters, as well as, varying wash conditions. The selection of a particular set of hybridization conditions is selected following standard methods in the art (see, for example, Sambrook, et al., supra or Ausubel et al., supra).

A first polynucleotide is "derived from" second polynucleotide if it has the same or substantially the same basepair sequence as a region of the second polynucleotide, its cDNA, complements thereof, or if it displays sequence identity as described above.

A first polypeptide is "derived from" a second polypeptide if it is (i) encoded by a first polynucleotide derived from a second polynucleotide, or (ii) displays sequence identity to the second polypeptides as described above.

Generally, a viral polypeptide is "derived from" a particular polypeptide of a virus (viral polypeptide) if it is (i) encoded by an open reading frame of a polynucleotide of that virus (viral polynucleotide), or (ii) displays sequence identity to polypeptides of that virus as described above.

"Encoded by" refers to a nucleic acid sequence which codes for a polypeptide sequence, wherein the polypeptide sequence or a portion thereof contains an amino acid sequence of at least 3 to 5 amino acids, more preferably at least 8 to 10 amino acids, and even more preferably at least 15 to 20 amino acids from a polypeptide encoded by the nucleic acid sequence. Also encompassed are polypeptide sequences which are immunologically identifiable with a polypeptide encoded by the sequence. Further, polyproteins can be constructed by fusing in-frame two or more polynucleotide sequences encoding polypeptide or peptide products. Further, polycistronic coding sequences may be produced by placing two or more polynucleotide sequences encoding polypeptide products adjacent each other, typically under the control of one promoter, wherein each polypeptide coding sequence may be modified to include sequences for internal ribosome binding sites.

"Purified polynucleotide" refers to a polynucleotide of interest or fragment thereof which is essentially free, e.g., contains less than about 50%, preferably less than about 70%, and more preferably less than about 90%, of the protein with which the polynucleotide is naturally associated. Techniques for purifying polynucleotides of interest are well-known in the art and include, for example, disruption of the cell containing the polynucleotide with a chaotropic agent and separation of the polynucleotide(s) and proteins by ion-exchange chromatography, affinity chromatography and sedimentation according to density.

By "nucleic acid immunization" is meant the introduction of a nucleic acid molecule encoding one or more selected antigens into a host cell, for the in vivo expression of an antigen, antigens, an epitope, or epitopes. The nucleic acid molecule can be introduced directly into a recipient subject, such as by injection, inhalation, oral, intranasal and mucosal administration, or the like, or can be introduced ex vivo, into cells which have been removed from the host. In the latter case, the transformed cells are reintroduced into the subject where an immune response can be mounted against the antigen encoded by the nucleic acid molecule.

"Gene transfer" or "gene delivery" refers to methods or systems for reliably inserting DNA of interest into a host cell. Such methods can result in transient expression of non-integrated transferred DNA, extrachromosomal replication and expression of transferred replicons (e.g., episomes), or integration of transferred genetic material into the genomic DNA of host cells. Gene delivery expression vectors include, but are not limited to, vectors derived from alphaviruses, pox viruses and vaccinia viruses. When used for immunization, such gene delivery expression vectors may be referred to as vaccines or vaccine vectors.

"T lymphocytes" or "T cells" are non-antibody producing lymphocytes that constitute a part of the cell-mediated arm of the immune system. T cells arise from immature lymphocytes that migrate from the bone marrow to the thymus, where they undergo a maturation process under the direction of thymic hormones. Here, the mature lymphocytes rapidly divide increasing to very large numbers. The maturing T cells become immunocompetent based on their ability to recognize and bind a specific antigen. Activation of immunocompetent T cells is triggered when an antigen binds to the lymphocyte's surface receptors.

The term "transfection" is used to refer to the uptake of foreign DNA by a cell. A cell has been "transfected" when exogenous DNA has been introduced inside the cell membrane. A number of transfection techniques are generally known in the art. See, e.g., Graham et al. (1973) *Virology*, 52:456, Sambrook et al. (1989) *Molecular Cloning, a laboratory manual*, Cold Spring Harbor Laboratories, New York, Davis et al. (1986) *Basic Methods in Molecular Biology*, Elsevier, and Chu et al. (1981) *Gene* 13:197. Such techniques can be used to introduce one or more exogenous DNA moieties into suitable host cells. The term refers to both stable and transient uptake of the genetic material, and includes uptake of peptide- or antibody-linked DNAs.

A "vector" is capable of transferring gene sequences to target cells (e.g., viral vectors, non-viral vectors, particulate carriers, and liposomes). Typically, "vector construct," "expression vector," and "gene transfer vector," mean any nucleic acid construct capable of directing the expression of a gene of interest and which can transfer gene sequences to target cells. Thus, the term includes cloning and expression vehicles, as well as viral vectors.

Transfer of a "suicide gene" (e.g., a drug-susceptibility gene) to a target cell renders the cell sensitive to compounds or compositions that are relatively nontoxic to normal cells. Moolten, F. L. (1994) *Cancer Gene Ther.* 1:279–287. Examples of suicide genes are thymidine kinase of herpes simplex virus (HSV-tk), cytochrome P450 (Manome et al. (1996) *Gene Therapy* 3:513–520), human deoxycytidine kinase (Manome et al. (1996) *Nature Medicine* 2(5):567–573) and the bacterial enzyme cytosine deaminase (Dong et al. (1996) *Human Gene Therapy* 7:713–720). Cells which express these genes are rendered sensitive to the effects of the relatively nontoxic prodrugs ganciclovir (HSV-tk), cyclophosphamide (cytochrome P4502B 1), cytosine arabinoside (human deoxycytidine kinase) or 5-fluorocytosine (bacterial cytosine deaminase). Culver et al. (1992) *Science* 256:1550–1552, Huber et al. (1994) *Proc. Natl. Acad. Sci. USA* 91:8302–8306.

A "selectable marker" or "reporter marker" refers to a nucleotide sequence included in a gene transfer vector that has no therapeutic activity, but rather is included to allow for simpler preparation, manufacturing, characterization or testing of the gene transfer vector.

A "specific binding agent" refers to a member of a specific binding pair of molecules wherein one of the molecules specifically binds to the second molecule through chemical and/or physical means. One example of a specific binding agent is an antibody directed against a selected antigen.

By "subject" is meant any member of the subphylum chordata, including, without limitation, humans and other primates, including non-human primates such as rhesus macaque, chimpanzees and other apes and monkey species; farm animals such as cattle, sheep, pigs, goats and horses; domestic mammals such as dogs and cats; laboratory animals including rodents such as mice, rats and guinea pigs; birds, including domestic, wild and game birds such as chickens, turkeys and other gallinaceous birds, ducks, geese, and the like. The term does not denote a particular age. Thus, both adult and newborn individuals are intended to be covered. The system described above is intended for use in any of the above vertebrate species, since the immune systems of all of these vertebrates operate similarly.

By "pharmaceutically acceptable" or "pharmacologically acceptable" is meant a material which is not biologically or otherwise undesirable, i.e., the material may be administered to an individual in a formulation or composition without causing any undesirable biological effects or interacting in a deleterious manner with any of the components of the composition in which it is contained.

By "physiological pH" or a "pH in the physiological range" is meant a pH in the range of approximately 7.0 to 8.0 inclusive, more typically in the range of approximately 7.2 to 7.6 inclusive.

As used herein, "treatment" refers to any of (i) the prevention of infection or reinfection, as in a traditional vaccine, (ii) the reduction or elimination of symptoms, and (iii) the substantial or complete elimination of the pathogen in question. Treatment may be effected prophylactically (prior to infection) or therapeutically (following infection).

By "co-administration" is meant administration of more than one composition or molecule. Thus, co-administration includes concurrent administration or sequentially administration (in any order), via the same or different routes of administration. Non-limiting examples of co-administration regimes include, co-administration of nucleic acid and polypeptide; co-administration of different nucleic acids (e.g., different expression cassettes as described herein and/or different gene delivery vectors); and co-administration of different polypeptides (e.g., different HIV polypeptides and/or different adjuvants). The term also encompasses multiple administrations of one of the co-administered molecules or compositions (e.g., multiple administrations of one or more of the expression cassettes described herein followed by one or more administrations of a polypeptide-containing composition). In cases where the molecules or compositions are delivered sequentially, the time between each administration can be readily determined by one of skill in the art in view of the teachings herein.

"Lentiviral vector", and "recombinant lentiviral vector" refer to a nucleic acid construct which carries, and within certain embodiments, is capable of directing the expression of a nucleic acid molecule of interest. The lentiviral vector include at least one transcriptional promoter/enhancer or locus defining element(s), or other elements which control gene expression by other means such as alternate splicing, nuclear RNA export, post-translational modification of messenger, or post-transcriptional modification of protein. Such vector constructs must also include a packaging signal, long terminal repeats (LTRS) or portion thereof, and positive and negative strand primer binding sites appropriate to the retrovirus used (if these are not already present in the retroviral vector). Optionally, the recombinant lentiviral vector may also include a signal which directs polyadenylation, selectable markers such as Neo, TK, hygromycin, phleomycin, histidinol, or DHFR, as well as one or more restriction sites and a translation termination sequence. By way of example, such vectors typically include a 5' LTR, a tRNA binding site, a packaging signal, an origin of second strand DNA synthesis, and a 3'LTR or a portion thereof "Lentiviral vector particle" as utilized within the present invention refers to a lentivirus which carries at least one gene of interest. The retrovirus may also contain a selectable marker. The recombinant lentivirus is capable of reverse transcribing its genetic material (RNA) into DNA and incorporating this genetic material into a host cell's DNA upon infection. Lentiviral vector particles may have a lentiviral envelope, a non-lentiviral envelope (e.g., an ampho or VSV-G envelope), or a chimeric envelope.

"Nucleic acid expression vector" or "Expression cassette" refers to an assembly which is capable of directing the expression of a sequence or gene of interest. The nucleic acid expression vector includes a promoter which is operably linked to the sequences or gene(s) of interest. Other control elements may be present as well. Expression cassettes described herein may be contained within a plasmid construct. In addition to the components of the expression cassette, the plasmid construct may also include a bacterial origin of replication, one or more selectable markers, a signal which allows the plasmid construct to exist as single-stranded DNA (e.g., a M 13 origin of replication), a multiple cloning site, and a "mammalian" origin of replication (e.g., a SV40 or adenovirus origin of replication).

"Packaging cell" refers to a cell which contains those elements necessary for production of infectious recombinant retrovirus which are lacking in a recombinant retroviral vector. Typically, such packaging cells contain one or more expression cassettes which are capable of expressing proteins which encode Gag, pol and env proteins.

"Producer cell" or "vector producing cell" refers to a cell which contains all elements necessary for production of recombinant retroviral vector particles.

2. Modes of Carrying Out the Invention

Before describing the present invention in detail, it is to be understood that this invention is not limited to particular formulations or process parameters as such may, of course, vary. It is also to be understood that the terminology used herein is for the purpose of describing particular embodiments of the invention only, and is not intended to be limiting.

Although a number of methods and materials similar or equivalent to those described herein can be used in the practice of the present invention, the preferred materials and methods are described herein.

2.1.0. The HIV Genome

The HIV genome and various polypeptide-encoding regions are shown in Table A. The nucleotide positions are given relative to 8_5_TV1_C.ZA (FIG. 1; an HIV Type C isolate). However, it will be readily apparent to one of ordinary skill in the art in view of the teachings of the present disclosure how to determine corresponding regions in other HIV strains or variants (e.g., isolates $HIV_{IIIb}$, $HIV_{SF2}$, $HIV-1_{SF162}$, $HIV-1_{SF170}$, $HIV_{LAV}$, $HIV_{LAI}$, $HIV_{MN}$, $HIV-1_{CM235}$, $HIV-1_{US4}$, other HIV-1 strains from diverse subtypes (e.g., subtypes, A through G, and O), HIV-2 strains and diverse subtypes (e.g., $HIV-2_{UC1}$, and $HIV-2_{UC2}$), and simian immunodeficiency virus (SIV). (See, e.g., Virology, 3rd Edition (W. K. Joklik ed. 1988); *Fundamental Virology*, 2nd Edition (B. N. Fields and D. M. Knipe, eds. 1991); *Virology*, 3rd Edition (Fields, B N, D M Knipe, P M Howley, Editors, 1996, Lippincott-Raven, Philadelphia, Pa.; for a description of these and other related viruses), using for example, sequence comparison programs (e.g., BLAST and others described herein) or identification and alignment of structural features (e.g., a program such as the "ALB" program described herein that can identify the various regions).

TABLE A

Regions of the HIV Genome relative to 8_5_TV1_C.ZA

| Region | Position in nucleotide sequence |
|---|---|
| 5'LTR | 1–636 |
| U3 | 1–457 |
| R | 458–553 |
| U5 | 554–636 |
| NFkB II | 340–348 |
| NFkB I | 354–362 |

TABLE A-continued

Regions of the HIV Genome relative to 8_5_TV1_C.ZA

| Region | Position in nucleotide sequence |
|---|---|
| Sp 1 III | 379–388 |
| Sp 1 II | 390–398 |
| Sp 1 I | 400–410 |
| TATA Box | 429–433 |
| TAR | 474–499 |
| Poly A signal | 529–534 |
| PBS | 638–655 |
| p7 binding region, packaging signal | 685–791 |
| Gag: | 792–2285 |
| p17 | 792–1178 |
| p24 | 1179–1871 |
| Cyclophilin A bdg. | 1395–1505 |
| MHR | 1632–1694 |
| p2 | 1872–1907 |
| p7 | 1908–2072 |
| Frameshift slip | 2072–2078 |
| p1 | 2073–2120 |
| p6Gag | 2121–2285 |
| Zn motif I | 1950–1991 |
| Zn motif II | 2013–2054 |
| Pol: | 2072–5086 |
| p6Pol | 2072–2245 |
| Prot | 2246–2542 |
| p66RT | 2543–4210 |
| p15RNaseH | 3857–4210 |
| p31Int | 4211–5086 |
| Vif: | 5034–5612 |
| Hydrophilic region | 5292–5315 |
| Vpr: | 5552–5839 |
| Oligomerization | 5552–5677 |
| Amphipathic a-helix | 5597–5653 |
| Tat: | 5823–6038 and 8417–8509 |
| Tat-1 exon | 5823–6038 |
| Tat-2 exon | 8417–8509 |
| N-terminal domain | 5823–5885 |
| Trans-activation domain | 5886–5933 |
| Transduction domain | 5961–5993 |
| Rev: | 5962–6037 and 8416–8663 |
| Rev-1 exon | 5962–6037 |
| Rev-2 exon | 8416–8663 |
| High-affinity bdg. site | 8439–8486 |
| Leu-rich effector domain | 8562–8588 |
| Vpu: | 6060–6326 |
| Transmembrane domain | 6060–6161 |
| Cytoplasmic domain | 6162–6326 |
| Env (gp160): | 6244–8853 |
| Signal peptide | 6244–6324 |
| gp 120 | 6325–7794 |
| V1 | 6628–6729 |
| V2 | 6727–6852 |
| V3 | 7150–7254 |
| V4 | 7411–7506 |
| V5 | 7663–7674 |
| C1 | 6325–6627 |
| C2 | 6853–7149 |
| C3 | 7255–7410 |
| C4 | 7507–7662 |
| C5 | 7675–7794 |
| CD4 binding | 7540–7566 |
| gp41 | 7795–8853 |
| Fusion peptide | 7789–7842 |
| Oligomerization domain | 7924–7959 |
| N-terminal heptad repeat | 7921–8028 |
| C-terminal heptad repeat | 8173–8280 |
| Immunodominant region | 8023–8076 |
| Nef: | 8855–9478 |
| Myristoylation | 8858–8875 |
| SH3 binding | 9062–9091 |
| Polypurine tract | 9128–9154 |
| SH3 binding | 9296–9307 |

It will be readily apparent that one of skill in the art can readily align any sequence to that shown in Table A to determine relative locations of any particular HIV gene. For example, using one of the alignment programs described herein (e.g., BLAST), other HIV genonomic sequences can be aligned with 8_5_TV1_C.ZA (Table A) and locations of genes determined. Polypeptide sequences can be similarly aligned. For example, FIGS. 2A–2C shows the alignment of Env polypeptide sequences from various strains, relative to SF-162. As described in detail in co-owned WO/39303 (herein incorporated by reference), Env polypeptides (e.g., gp120, gp140 and gp160) include a "bridging sheet" comprised of 4 anti-parallel β-strands (β-2, β-3, β-20 and β-21) that form a β-sheet. Extruding from one pair of the β-strands (β-2 and β-3) are two loops, V1 and V2. The β-2 sheet occurs at approximately amino acid residue 113 (Cys) to amino acid residue 117 (Thr) while β-3 occurs at approximately amino acid residue 192 (Ser) to amino acid residue 194 (Ile), relative to SF-162. The "V1/V2 region" occurs at approximately amino acid positions 120 (Cys) to residue 189 (Cys), relative to SF-162. Extruding from the second pair of β-strands (β-20 and β-21) is a "small-loop" structure, also referred to herein as "the bridging sheet small loop." The locations of both the small loop and bridging sheet small loop can be determined relative to HXB-2 following the teachings herein and in WO/39303. Also shown by arrows in FIGS. 2A–C are approximate sites for deletions sequence from the beta sheet region. The "*" denotes N-glycosylation sites that can be mutated following the teachings of the present specification.

2.1.1. Wild-Type HIV Sequences

Isolated nucleotide sequences for various novel subtype C novel isolates are shown in Table Al below. Sequence were obtained and analyzed (e.g., phylogenetic tree analysis) as described in Engelbrecht et al (2001) *AIDS Res. Hum. Retroviruses* 17(16):1533–1547. (See, also, GenBank). Sequences of accessory proteins and analysis of these sequences is described in Scriba et al. (2001) *AIDS Res. Hum. Retroviruses* 17(8):775–781.

TABLE A1

Wild-Type Sequences

| Name | SEQ ID NO | Figure Number | Description |
|---|---|---|---|
| Env TV001c8.2 | 61 | 58 (2 sheets) | complete Env sequence of clone TV001c8.2 of isolate C-98TV001 |
| Env TV001c8.5 | 62 | 59 (2 sheets) | complete Env sequence of clone TV001c8.5 of isolate C-98TV001 |
| Env TV001c12.1 | 63 | 60 (2 sheets) | complete Env sequence of clone TV001c12.1 of isolate C-98TV002 |
| Env TV003cE260 | 64 | 61 (2 sheets) | complete Env sequence of clone TV003cE260 of isolate C-98TV003 |
| Env TV004cC300 | 65 | 62 (2 sheets) | complete Env sequence of clone TV004cC300 of isolate C-98TV004 |
| Env TV006c9.1 | 66 | 63 (2 sheets) | complete Env sequence of clone TV006c9.1 of isolate C-98TV006 |
| Env TV006c9.2 | 67 | 64 (2 sheets) | complete Env sequence of clone TV006c9.2 of isolate C-98TV006 |
| Env TV006cE9 | 68 | 65 (2 sheets) | complete Env sequence of clone TV006cE9 of isolate C-98TV006 |
| Env TV007cB104 | 69 | 66 (2 sheets) | complete Env sequence of clone TV007cB104 of isolate C-98TV007 |
| Env TV007cB105 | 70 | 67 (2 sheets) | complete Env sequence of clone TV007cB105 of isolate C-98TV007 |
| Env TV008c4.3 | 71 | 68 (2 sheets) | complete Env sequence of clone TV008c4.3 of isolate C-98TV008 |
| Env TV008c4.4 | 72 | 69 (2 sheets) | complete Env sequence of clone TV008c4.4 of isolate C-98TV008 |
| Env TV010cD7 | 73 | 70 (2 sheets) | complete Env sequence of clone TV010cD7 of isolate C-98TV010 |
| Env TV012c2.1 | 74 | 71 (2 sheets) | complete Env sequence of clone TV012c2.1 of isolate C-98TV012 |
| Env TV012c2.2 | 75 | 72 (2 sheets) | complete Env sequence of clone TV012c2.2 of isolate C-98TV012 |
| Env TV013cB20 | 76 | 73 (2 sheets) | complete Env sequence of clone TV013cB20 of isolate C-98TV013 |
| Env TV013cH17 | 77 | 74 (2 sheets) | complete Env sequence of clone TV013cH17 of isolate C-98TV013 |
| Env TV014c6.3 | 78 | 75 (2 sheets) | complete Env sequence of clone TV014c6.3 of isolate C-98TV014 |
| Env TV014c6.4 | 79 | 76 (2 sheets) | complete Env sequence of clone TV014c6.4 of isolate C-98TV014 |
| Env TV018cF1027 | 80 | 77 (2 sheets) | complete Env sequence of clone TV018cF1027 of isolate C-98TV018 |
| Env TV019c5 | 81 | 78 (2 sheets) | complete Env sequence of clone TV019c5 of isolate C-98TV019 |
| Gag TV001G8 | 82 | 79 | complete Gag sequence of clone TV001G8 of isolate C-98TV001 |
| Gag TV001G11 | 83 | 80 | complete Gag sequence of clone TV001G11 of isolate C-98TV001 |
| Gag TV002G8 | 84 | 81 | complete Gag sequence of clone TV002G8 of isolate C-98TV002 |
| Gag TV003G15 | 85 | 82 | complete Gag sequence of clone TV003G15 of isolate C-98TV003 |

TABLE A1-continued

Wild-Type Sequences

| Name | SEQ ID NO | Figure Number | Description |
| --- | --- | --- | --- |
| Gag TV004G17 | 86 | 83 | complete Gag sequence of clone TV004G17 of isolate C-98TV004 |
| Gag TV004G24 | 87 | 84 | complete Gag sequence of clone TV004G24 of isolate C-98TV004 |
| Gag TV006G11 | 88 | 85 | complete Gag sequence of clone TV006G11 of isolate C-98TV006 |
| Gag TV006G97 | 89 | 86 | complete Gag sequence of clone TV006G97 of isolate C-98TV006 |
| Gag TV007G59 | 90 | 87 | complete Gag sequence of clone TV007G59 of isolate C-98TV009 |
| Gag TV008G65 | 91 | 88 | complete Gag sequence of clone TV008G65 of isolate C-98TV008 |
| Gag TV008G66 | 92 | 89 | complete Gag sequence of clone TV008G66 of isolate C-98TV008 |
| Gag TV010G74 | 93 | 90 | complete Gag sequence of clone TV010G74 of isolate C-98TV010 |
| Gag TV012G34 | 94 | 91 | complete Gag sequence of clone TV012G34 of isolate C-98TV012 |
| Gag TV012G40 | 95 | 92 | complete Gag sequence of clone TV012G40 of isolate C-98TV012 |
| Gag TV013G2 | 96 | 93 | complete Gag sequence of clone TV013G2 of isolate C-98TV013 |
| Gag TV013G15 | 97 | 94 | complete Gag sequence of clone TV013G15 of isolate C-98TV013 |
| Gag TV014G73 | 98 | 95 | complete Gag sequence of clone TV014G73 of isolate C-98TV014 |
| Gag TV018G60 | 99 | 96 | complete Gag sequence of clone TV018G60 of isolate C-98TV018 |
| Gag TV019G20 | 100 | 97 | complete Gag sequence of clone TV019G20 of isolate C-98TV019 |
| Gag TV019G25 | 101 | 98 | complete Gag sequence of clone TV019G25 of isolate C-98TV019 |
| 8_2_TV1 LTR | 181 | 102 (2 sheets) | sequence from the 3' region of the clone designated 8_2_TV1 |
| 2_1/4_TV12_C_ZA | 182 | 103 (5 sheets) | sequence of 2_1/4_TV12_C_ZA |

2.2.0 Synthetic Expression Cassettes

One aspect of the present invention is the generation of HIV-1 coding sequences, and related sequences, for example having improved expression relative to the corresponding wild-type sequences.

2.2.1 Modification of HIV-1 Nucleic Acid Coding Sequences

First, the HIV-1 codon usage pattern was modified so that the resulting nucleic acid coding sequence was comparable to codon usage found in highly expressed human genes. The HIV codon usage reflects a high content of the nucleotides A or T of the codon-triplet. The effect of the HIV-1 codon usage is a high AT content in the DNA sequence that results in a decreased translation ability and instability of the mRNA. In comparison, highly expressed human codons prefer the nucleotides G or C. The HIV coding sequences were modified to be comparable to codon usage found in highly expressed human genes.

Second, there are inhibitory (or instability) elements (INS) located within the coding sequences of, for example, the Gag coding sequences. The RRE is a secondary RNA structure that interacts with the HIV encoded Rev-protein to overcome the expression down-regulating effects of the INS. To overcome the post-transcriptional activating mechanisms of RRE and Rev, the instability elements can be inactivated by introducing multiple point mutations that do not alter the reading frame of the encoded proteins.

Third, for some genes the coding sequence has been altered such that the polynucleotide coding sequence encodes a gene product that is inactive or non-functional (e.g., inactivated polymerase, protease, tat, rev, nef, vif, vpr, and/or vpu gene products). Example 1 describes some exemplary mutations. Example 8 presents information concerning functional analysis of mutated Tat, Rev and Nef antigens.

The synthetic coding sequences are assembled by methods known in the art, for example by companies such as the Midland Certified Reagent Company (Midland, Tex.).

Modification of the Gag polypeptide coding sequences results in improved expression relative to the wild-type coding sequences in a number of mammalian cell lines (as well as other types of cell lines, including, but not limited to, insect cells).

Some exemplary polynucleotide sequences encoding Gag-containing polypeptides are GagComplPolmut_C, GagComplPolmutAtt_C, GagComplPolmutIna_C, GagComplPolmutInaTatRevNef_C, GagPolmut_C, GagPolmutAtt_C, GagPolmutIna_C, GagProtInaRTmut_C, GagProtInaRTmutTatRevNef_C, GagRTmut_C, GagRTmutTatRevNef_C, GagTatRevNef_C, and gp120mod.TV1.del118-210.

Similarly, the present invention also includes synthetic Env-encoding polynucleotides and modified Env proteins, for example, gp120mod.TV1.del118-210, gp120mod.TV1.delV1V2, gp120mod.TV1.delV2, gp140mod.TV1.del118-210, gp140mod.TV1.delV1V2, gp140mod.TV1.delV2, gp140mod.TV1.mut7, gp140mod.TV1.tpa2, gp140TMmod.TV1, gp160mod.TV1.del118-210, gp160mod.TV1.delV1V2, gp160mod.TV1.delV2, gp160mod.TV1.dV1, gp160mod.TV1.dV1-gagmod.BW965, gp160mod.TV1.dV1 V2-gagmod.BW965, gp160mod.TV1.dV2-gagmod.BW965, gp160mod.TV1.tpa2, and gp160mod.TV1-gagmod.BW965.

The codon usage pattern for Env was modified as described above for Gag so that the resulting nucleic acid coding sequence was comparable to codon usage found in highly expressed human genes. Experiments performed in support of the present invention show that the synthetic Env sequences were capable of higher level of protein production relative to the native Env sequences.

Modification of the Env polypeptide coding sequences results in improved expression relative to the wild-type coding sequences in a number of mammalian cell lines (as well as other types of cell lines, including, but not limited to, insect cells). Similar Env polypeptide coding sequences can be obtained, modified and tested for improved expression from a variety of isolates, including those described above for Gag.

Further modifications of Env include, but are not limited to, generating polynucleotides that encode Env polypeptides having mutations and/or deletions therein. For instance, the hypervariable regions, V1 and/or V2, can be deleted as described herein. Additionally, other modifications, for example to the bridging sheet region and/or to N-glycosylation sites within Env can also be performed following the teachings of the present specification. (see, FIGS. 2A–C, as well as WO 00/39303, WO 00/39302, WO 00/39304, WO 02/04493, all herein incorporated by reference in their entireties). Various combinations of these modifications can be employed to generate synthetic expression cassettes as described herein.

The present invention also includes expression cassettes which include synthetic Pol sequences. As noted above, "Pol" includes, but is not limited to, the protein-encoding regions comprising polymerase, protease, reverse transcriptase and/or integrase-containing sequences (Wan et et al (1996) *Biochem. J.* 316:569–573; Kohl et al. (1988) *PNAS USA* 85:4686–4690; Krausslich et al. (1988) *J. Virol.* 62:4393–4397; Coffin, "Retroviridae and their Replication" in Virology, pp 1437–1500 (Raven, N.Y., 1990); Patel et. al. (1995) *Biochemistry* 34:5351–5363). Thus, the synthetic expression cassettes exemplified herein include one or more of these regions and one or more changes to the resulting amino acid sequences. Some exemplary polynucleotide sequences encoding Pol-derived polypeptides are presented in Table C.

The codon usage pattern for Pol was modified as described above for Gag and Env so that the resulting nucleic acid coding sequence was comparable to codon usage found in highly expressed human genes.

Constructs may be modified in various ways. For example, the expression constructs may include a sequence that encodes the first 6 amino acids of the integrase polypeptide. This 6 amino acid region is believed to provide a cleavage recognition site recognized by HIV protease (see, e.g., McCornack et al. (1997) *FEBS Letts* 414:84–88). Constructs may include a multiple cloning site (MCS) for insertion of one or more transgenes, typically at the 3' end of the construct. In addition, a cassette encoding a catalytic center epitope derived from the catalytic center in RT is typically included 3' of the sequence encoding 6 amino acids of integrase. This cassette encodes Ile178 through Serine 191 of RT and may be added to keep this well conserved region as a possible CTL epitope. Further, the constructs contain an insertion mutations to preserve the reading frame. (see, e.g., Park et al. (1991) *J. Virol.* 65:5111).

In certain embodiments, the catalytic center and/or primer grip region of RT are modified. The catalytic center and primer grip regions of RT are described, for example, in Patel et al. (1995) *Biochem.* 34:5351 and Palaniappan et al. (1997) *J. Biol. Chem.* 272(17): 11157. For example, wild type sequence encoding the amino acids YMDD at positions 183–185 of p 66 RT, numbered relative to AF110975, may be replaced with sequence encoding the amino acids "AP". Further, the primer grip region (amino acids WMGY, residues 229–232 of p 66RT, numbered relative to AF110975) may be replaced with sequence encoding the amino acids "PI."

For the Pol sequence, the changes in codon usage are typically restricted to the regions up to the −1 frameshift and starting again at the end of the Gag reading frame; however, regions within the frameshift translation region can be modified as well. Finally, inhibitory (or instability) elements (INS) located within the coding sequences of the protease polypeptide coding sequence can be altered as well.

Experiments can be performed in support of the present invention to show that the synthetic Pol sequences were capable of higher level of protein production relative to the native Pol sequences. Modification of the Pol polypeptide coding sequences results in improved expression relative to the wild-type coding sequences in a number of mammalian cell lines (as well as other types of cell lines, including, but not limited to, insect cells). Similar Pol polypeptide coding sequences can be obtained, modified and tested for improved expression from a variety of isolates, including those described above for Gag and Env.

The present invention also includes expression cassettes which include synthetic sequences derived HIV genes other than Gag, Env and Pol, including but not limited to, regions within Gag, Env, Pol, as well as, GagComplPolmut_C, GagComplPolmutAtt_C, GagComplPolmutIna_C, GagComplPolmutInaTatRevNef_C, GagPolmut_C, GagPolmutAtt_C, GagPolmutIna_C, GagProtInaRTmut_C, GagProtInaRTmutTatRevNef_C, GagRTmut_C, GagRTmutTatRevNef_C, GagTatRevNef_C, gp120mod.TV1.del118-210, gp120mod.TV1.delV1V2, gp120mod.TV1.delV2, gp140mod.TV1.del118-210, gp140mod.TV1.delV1 V2, gp140mod.TV1.delV2, gp140mod.TV1.mut7, gp140mod.TV1.tpa2, gp140TMmod.TV1, gp160mod.TV1.del118-210, gp160mod.TV1.delV1V2, gp160mod.TV1.delV2, gp160mod.TV1.dV1, gp160mod.TV1.dV1-gagmod.BW965, gp160mod.TV1.dV1V2-gagmod.BW965, gp160mod.TV1.dV2-gagmod.BW965, gp160mod.TV1.tpa2, gp160mod.TV1-gagmod.BW965, int.opt.mut_C, int.opt_C, nef.D 106G.-myr19.opt_C, p15RnaseH.opt_C, p2Pol.opt.YMWM_C, p2Polopt.YM_C, p2Polopt_C, p2PolTatRevNef opt C, p2PolTatRevNef. opt. native_C, p2PolTatRevNef.opt_C, protInaRT. YM. opt_C, protInaRT.YMWM.opt_C, ProtRT.TatRevNef.opt_C, rev.exon1_2.M5-10.opt_C, tat.exon1_2.opt.C22-37_C, tat.exon1_2.opt.C37_C, TatRevNef.opt.native_ZA, TatRevNef.opt_ZA, TatRevNefGag C, TatRevNefgagCpolIna C, TatRevNefGagProtInaRTmut C, and TatRevNefProtRT opt C. Sequences obtained from other strains can be manipulated in similar fashion following the teachings of the present specification. As noted above, the codon usage pattern is modified as described above for Gag, Env and Pol so that the resulting nucleic acid coding sequence is comparable to codon usage found in highly expressed human genes. Typically these synthetic sequences are capable of higher level of protein production relative to the native sequences and that modification of the wild-type polypeptide coding sequences results in improved expression relative to the wild-type coding sequences in a number of mammalian cell lines (as well as other types of cell lines, including, but not limited to, insect cells). Furthermore, the nucleic acid sequence can also be modified to introduce mutations into one or more regions of the gene, for instance to alter the function of the gene product (e.g., render the gene product non-functional) and/or to eliminate site modifications (e.g., the myristoylation site in Nef).

Synthetic expression cassettes, derived from HIV Type C coding sequences, exemplified herein include, but are not limited to, those comprising one or more of the following synthetic polynucleotides: GagComplPolmut_C, GagComplPolmutAtt_C, GagComplPolmutIna_C, GagComplPolmutInaTatRevNef C, GagPolmut_C, GagPolmutAtt_C, GagPolmutIna_C, GagProtInaRTmut_C, GagProtInaRTmutTatRevNef_C, GagRTmut_C, GagRTmutTatRevNef_C, GagTatRevNef_C, gp120mod.TV1.del118-210, gp120mod.TV1.delV1V2, gp120mod.TV1.delV2, gp140mod.TV1.del118-210, gp140mod.TV1.delV1V2, gp140mod.TV1.delV2, gp140mod.TV1.mut7, gp140mod.TV1.tpa2, gp140TMmod.TV1, gp160mod.TV1.del118-210, gp160mod.TV1.delV1V2, gp160mod.TV1.delV2, gp160mod.TV1.dV1, gp160mod.TV1.dV1-gagmod.BW965, gp160mod.TV1.dV1 V2-gagmod.BW965, gp160mod.TV1.dV2-gagmod.BW965, gp160mod.TV1.tpa2, gp160mod.TV1-gagmod.BW965, int.opt.mut_C, int.opt_C, nef.D 106G.-myr19.opt_C, p15RnaseH.opt_C, p2Pol.opt.YMWM_C, p2Polopt.YM_C, p2Polopt_C, p2PolTatRevNef opt C, p2PolTatRevNef.opt.native_C, p2PolTatRevNef.opt_C, protInaRT.YM.opt_C, protInaRT.YMWM.opt_C, ProtRT.TatRevNef.opt_C, rev.exon1_2.M5-10.opt_C, tat.exon1_2.opt.C22-37_C, tat.exon1_2.opt.C37_C, TatRevNef.opt-.native_ZA, TatRevNef.opt_ZA, TatRevNefGag C, TatRevNefgagCpolIna C, TatRevNefGagProtInaRTmut C, and TatRevNefProtRT opt C.

Gag-complete refers to in-frame polyproteins comprising, e.g., Gag and pol, wherein the p6 portion of Gag is present.

Additional sequences that may be employed in some aspects of the present invention have been described in WO 00/39302, WO 00/39303, WO 00/39304, and WO 02/04493, all of which are herein incorporated by reference in their entireties.

2.2.2 Further Modification of Sequences Including HIV Nucleic Acid Coding Sequences The HIV polypeptide-encoding expression cassettes described herein may also contain one or more further sequences encoding, for example, one or more transgenes. Further sequences (e.g., transgenes) useful in the practice of the present invention include, but are not limited to, further sequences are those encoding further viral epitopes/antigens {including but not limited to, HCV antigens (e.g., E1, E2; Houghton, M., et al., U.S. Pat. No. 5,714,596, issued Feb. 3, 1998; Houghton, M., et al., U.S. Pat. No. 5,712,088, issued Jan. 27, 1998; Houghton, M., et al., U.S. Pat. No. 5,683,864, issued Nov. 4, 1997; Weiner, A. J., et al., U.S. Pat. No. 5,728,520, issued Mar. 17, 1998; Weiner, A. J., et al., U.S. Pat. No. 5,766,845, issued Jun. 16, 1998; Weiner, A. J., et al., U.S. Pat. No. 5,670,152, issued Sep. 23, 1997; all herein incorporated by reference), HIV antigens (e.g., derived from one or more HIV isolate); and sequences encoding tumor antigens/epitopes. Further sequences may also be derived from non-viral sources, for instance, sequences encoding cytokines such interleukin-2 (IL-2), stem cell factor (SCF), interleukin 3 (IL-3), interleukin 6 (IL-6), interleukin 12 (IL-12), G-CSF, granulocyte macrophage-colony stimulating factor (GM-CSF), interleukin-1 alpha (IL-1I), interleukin-11 (IL-11), MIP-1I, tumor necrosis factor (TNF), leukemia inhibitory factor (LIF), c-kit ligand, thrombopoietin (TPO) and flt3 ligand, commercially available from several vendors such as, for example, Genzyme (Framingham, Mass.), Genentech (South San Francisco, Calif.), Amgen (Thousand Oaks, Calif.), R&D Systems and Immunex (Seattle, Wash.). Additional sequences are described below. Also, variations on the orientation of the Gag and other coding sequences, relative to each other, are described below.

HIV polypeptide coding sequences can be obtained from other HIV isolates, see, e.g., Myers et al. Los Alamos Database, Los Alamos National Laboratory, Los Alamos, N. Mex. (1992); Myers et al., *Human Retroviruses and Aids*, 1997, Los Alamos, N. Mex.: Los Alamos National Laboratory. Synthetic expression cassettes can be generated using such coding sequences as starting material by following the teachings of the present specification.

Further, the synthetic expression cassettes of the present invention include related polypeptide sequences having greater than 85%, preferably greater than 90%, more preferably greater than 95%, and most preferably greater than 98% sequence identity to the polypeptides encoded by the synthetic expression cassette sequences disclosed herein.

Exemplary expression cassettes and modifications are set forth in Example 1.

2.2.3 Expression of Synthetic Sequences Encoding HIV-1 Polypeptides and Related Polypeptides Synthetic HIV-encoding sequences (expression cassettes) of the present invention can be cloned into a number of different expression vectors to evaluate levels of expression and, in the case of Gag-containing constructs, production of VLPs. The synthetic DNA fragments for HIV polypeptides can be cloned into eucaryotic expression vectors, including, a transient expression vector, CMV-promoter-based mammalian vectors, and a shuttle vector for use in baculovirus expression systems. Corresponding wild-type sequences can also be cloned into the same vectors.

These vectors can then be transfected into a several different cell types, including a variety of mammalian cell lines (293, RD, COS-7, and CHO, cell lines available, for example, from the A.T.C.C.). The cell lines are then cultured under appropriate conditions and the levels of any appropriate polypeptide product can be evaluated in supernatants. (see, Table A). For example, p24 can be used to evaluate Gag expression; gp160, gp140 or gp120 can be used to evaluate Env expression; p6pol can be used to evaluate Pol expression; prot can be used to evaluate protease; p15 for RNAseH; p31 for Integrase; and other appropriate polypeptides for Vif, Vpr, Tat, Rev, Vpu and Nef. Further, modified polypeptides can also be used, for example, other Env polypeptides include, but are not limited to, for example, native gp160, oligomeric gp140, monomeric gp120 as well as modified and/or synthetic sequences of these polypeptides. The results of these assays demonstrate that expression of synthetic HIV polypeptide-encoding sequences are significantly higher than corresponding wild-type sequences.

Further, Western Blot analysis can be used to show that cells containing the synthetic expression cassette produce the expected protein at higher per-cell concentrations than cells containing the native expression cassette. The HIV proteins can be seen in both cell lysates and supernatants.

The levels of production are significantly higher in cell supernatants for cells transfected with the synthetic expression cassettes of the present invention.

Fractionation of the supernatants from mammalian cells transfected with the synthetic expression cassette can be used to show that the cassettes provide superior production of HIV proteins and, in the case of Gag, VLPs, relative to the wild-type sequences.

Efficient expression of these HIV-containing polypeptides in mammalian cell lines provides the following benefits: the polypeptides are free of baculovirus contaminants; production by established methods approved by the FDA; increased purity; greater yields (relative to native coding sequences); and a novel method of producing the Sub HIV-containing polypeptides in CHO cells which is not feasible in the absence of the increased expression obtained using the constructs of the present invention. Exemplary Mammalian cell lines include, but are not limited to, BHK, VERO, HT1080, 293, 293T, RD, COS-7, CHO, Jurkat, HUT, SUPT, C8166, MOLT4/clone8, MT-2, MT-4, H9, PMI, CEM, and CEMX174 (such cell lines are available, for example, from the A.T.C.C.).

A synthetic Gag expression cassette of the present invention will also exhibit high levels of expression and VLP production when transfected into insect cells. Synthetic expression cassettes described herein also demonstrate high levels of expression in insect cells. Further, in addition to a higher total protein yield, the final product from the synthetic polypeptides consistently contains lower amounts of contaminating baculovirus proteins than the final product from the native sequences.

Further, synthetic expression cassettes of the present invention can also be introduced into yeast vectors which, in turn, can be transformed into and efficiently expressed by yeast cells (*Saccharomyces cerevisea*; using vectors as described in Rosenberg, S. and Tekamp-Olson, P., U.S. Pat. No. RE35,749, issued, Mar. 17, 1998, herein incorporated by reference).

In addition to the mammalian and insect vectors, the synthetic expression cassettes of the present invention can be incorporated into a variety of expression vectors using selected expression control elements. Appropriate vectors and control elements for any given cell an be selected by one having ordinary skill in the art in view of the teachings of the present specification and information known in the art about expression vectors.

For example, a synthetic expression cassette can be inserted into a vector which includes control elements operably linked to the desired coding sequence, which allow for the expression of the gene in a selected cell-type. For example, typical promoters for mammalian cell expression include the SV40 early promoter, a CMV promoter such as the CMV immediate early promoter (a CMV promoter can include intron A), RSV, HIV-Ltr, the mouse mammary tumor virus LTR promoter (MMLV-ltr), the adenovirus major late promoter (Ad MLP), and the herpes simplex virus promoter, among others. Other nonviral promoters, such as a promoter derived from the murine metallothionein gene, will also find use for mammalian expression. Typically, transcription termination and polyadenylation sequences will also be present, located 3' to the translation stop codon. Preferably, a sequence for optimization of initiation of translation, located 5' to the coding sequence, is also present. Examples of transcription terminator/polyadenylation signals include those derived from SV40, as described in Sambrook, et al., supra, as well as a bovine growth hormone terminator sequence. Introns, containing splice donor and acceptor sites, may also be designed into the constructs for use with the present invention (Chapman et al., *Nuc. Acids Res.* (1991) 19:3979–3986).

Enhancer elements may also be used herein to increase expression levels of the mammalian constructs. Examples include the SV40 early gene enhancer, as described in Dijkema et al., *EMBO J.* (1985) 4:761, the enhancer/promoter derived from the long terminal repeat (LTR) of the Rous Sarcoma Virus, as described in Gorman et al., *Proc. Natl. Acad. Sci. USA* (1982b) 79:6777 and elements derived from human CMV, as described in Boshart et al., *Cell* (1985) 411:521, such as elements included in the CMV intron A sequence (Chapman et al., *Nuc. Acids Res.* (1991) 19:3979–3986).

The desired synthetic polypeptide encoding sequences can be cloned into any number of commercially available vectors to generate expression of the polypeptide in an appropriate host system. These systems include, but are not limited to, the following: baculovirus expression {Reilly, P. R., et al., *BACULOVIRUS EXPRESSION VECTORS: A LABORATORY MANUAL* (1992); Beames, et al., *Biotechniques* 11:378 (1991); Pharmingen; Clontech, Palo Alto, Calif.)}, vaccinia expression {Earl, P. L., et al., "Expression of proteins in mammalian cells using vaccinia" In *Current Protocols in Molecular Biology* (F. M. Ausubel, et al. Eds.), Greene Publishing Associates & Wiley Interscience, New York (1991); Moss, B., et al., U.S. Pat. No. 5,135,855, issued Aug. 4, 1992}, expression in bacteria {Ausubel, F. M., et al., *CURRENT PROTOCOLS IN MOLECULAR BIOLOGY*, John Wiley and Sons, Inc., Media PA; Clontech}, expression in yeast {Rosenberg, S. and Tekamp-Olson, P., U.S. Pat. No. RE35,749, issued, Mar. 17, 1998, herein incorporated by reference; Shuster, J. R., U.S. Pat. No. 5,629,203, issued May 13, 1997, herein incorporated by reference; Gellissen, G., et al., *Antonie Van Leeuwenhoek*, 62(1–2):79–93 (1992); Romanos, M. A., et al., *Yeast* 8(6):423–488 (1992); Goeddel, D. V., *Methods in Enzymology* 185 (1990); Guthrie, C., and G. R. Fink, *Methods in Enzymology* 194 (1991)}, expression in mammalian cells {Clontech; Gibco-BRL, Ground Island, N.Y.; e.g., Chinese hamster ovary (CHO) cell lines (Haynes, J., et al., *Nuc. Acid. Res.* 11:687–706 (1983); 1983, Lau, Y. F., et al., *Mol. Cell. Biol.* 4:1469–1475 (1984); Kaufman, R. J., "Selection and coamplification of heterologous genes in mammalian cells," in *Methods in Enzymology, vol.* 185, pp 537–566. Academic Press, Inc., San Diego Calif. (1991)}, and expression in plant cells {plant cloning vectors, Clontech Laboratories, Inc., Palo Alto, Calif., and Pharmacia LKB Biotechnology, Inc., Pistcataway, N.J.; Hood, E., et al., *J. Bacteriol.* 168:1291–1301 (1986); Nagel, R., et al., *FEMS Microbiol. Lett.* 67:325 (1990); An, et al., "Binary Vectors", and others in *Plant Molecular Biology Manual A*3:1–19 (1988); Miki, B. L. A., et al., pp. 249–265, and others in *Plant DNA Infectious Agents* (Hohn, T., et al., eds.) Springer-Verlag, Wien, Austria, (1987); *Plant Molecular Biology: Essential Techniques*, P. G. Jones and J. M. Sutton, New York, J. Wiley, 1997; Miglani, Gurbachan *Dictionary of Plant Genetics and Molecular Biology*, New York, Food Products Press, 1998; Henry, R. J., *Practical Applications of Plant Molecular Biology*, New York, Chapman & Hall, 1997}.

Also included in the invention is an expression vector, containing coding sequences and expression control elements which allow expression of the coding regions in a suitable host. The control elements generally include a promoter, translation initiation codon, and translation and transcription termination sequences, and an insertion site for introducing the insert into the vector. Translational control elements have been reviewed by M. Kozak (e.g., Kozak, M., *Mamm. Genome* 7(8):563–574, 1996; Kozak, M., *Biochimie* 76(9):815–821, 1994; Kozak, M., *J Cell Biol* 108(2):229–241, 1989; Kozak, M., and Shatkin, A. J., *Methods Enzymol* 60:360–375, 1979).

Expression in yeast systems has the advantage of commercial production. Recombinant protein production by vaccinia and CHO cell line have the advantage of being mammalian expression systems. Further, vaccinia virus expression has several advantages including the following: (i) its wide host range; (ii) faithful post-transcriptional modification, processing, folding, transport, secretion, and assembly of recombinant proteins; (iii) high level expression of relatively soluble recombinant proteins; and (iv) a large capacity to accommodate foreign DNA.

The recombinantly expressed polypeptides from synthetic HIV polypeptide-encoding expression cassettes are typically isolated from lysed cells or culture media. Purification can be carried out by methods known in the art including salt fractionation, ion exchange chromatography, gel filtration, size-exclusion chromatography, size-fractionation, and affinity chromatography. Immunoaffinity chromatography can be employed using antibodies generated based on, for example, HIV antigens.

Advantages of expressing the proteins of the present invention using mammalian cells include, but are not limited to, the following: well-established protocols for scale-up production; the ability to produce VLPs; cell lines are suitable to meet good manufacturing process (GMP) standards; culture conditions for mammalian cells are known in the art.

Synthetic HIV 1 polynucleotides are described herein, see, for example, the figures. Various forms of the different embodiments of the invention, described herein, may be combined.

Exemplary expression assays are set forth in Example 2. Exemplary conditions for Western Blot analysis are presented in Example 3.

2.3.0 Production of Virus-Like Particles and use of the Constructs of the Present Invention To Create Packaging Cell lines.

The group-specific antigens (Gag) of human immunodeficiency virus type-1 (HIV-1) self-assemble into noninfectious virus-like particles (VLP) that are released from various eucaryotic cells by budding (reviewed by Freed, E. O., *Virology* 251: 1–15, 1998). The Gag-containing synthetic expression cassettes of the present invention provide for the production of HIV-Gag virus-like particles (VLPs) using a variety of different cell types, including, but not limited to, mammalian cells.

Viral particles can be used as a matrix for the proper presentation of an antigen entrapped or associated therewith to the immune system of the host.

2.3.1 VLP Production Using the Synthetic Expression Cassettes of the Present Invention The Gag-containing synthetic expression cassettes of the present invention may provide superior production of both Gag proteins and VLPs, relative to native Gag coding sequences. Further, electron microscopic evaluation of VLP production can be used to show that free and budding immature virus particles of the expected size are produced by cells containing the synthetic expression cassettes.

Using the synthetic expression cassettes of the present invention, rather than native Gag coding sequences, for the production of virus-like particles provide several advantages. First, VLPs can be produced in enhanced quantity making isolation and purification of the VLPs easier. Second, VLPs can be produced in a variety of cell types using the synthetic expression cassettes, in particular, mammalian cell lines can be used for VLP production, for example, CHO cells. Production using CHO cells provides (i) VLP formation; (ii) correct myristoylation and budding; (iii) absence of non-mamallian cell contaminants (e.g., insect viruses and/or cells); and (iv) ease of purification. The synthetic expression cassettes of the present invention are also useful for enhanced expression in cell-types other than mammalian cell lines. For example, infection of insect cells with baculovirus vectors encoding the synthetic expression cassettes results in higher levels of total Gag protein yield and higher levels of VLP production (relative to wild-oding sequences). Further, the final product from insect cells infected with the baculovirus-Gag synthetic expression cassettes consistently contains lower amounts of contaminating insect proteins than the final product when wild-oding sequences are used.

VLPs can spontaneously form when the particle-forming polypeptide of interest is recombinantly expressed in an appropriate host cell. Thus, the VLPs produced using the synthetic expression cassettes of the present invention are conveniently prepared using recombinant techniques. As discussed below, the Gag polypeptide encoding synthetic expression cassettes of the present invention can include other polypeptide coding sequences of interest (for example, HIV protease, HIV polymerase, Env; synthetic Env). Expression of such synthetic expression cassettes yields VLPs comprising the Gag polypeptide, as well as, the polypeptide of interest.

Once coding sequences for the desired particle-forming polypeptides have been isolated or synthesized, they can be cloned into any suitable vector or replicon for expression. Numerous cloning vectors are known to those of skill in the art, and the selection of an appropriate cloning vector is a matter of choice. See, generally, Sambrook et al, supra. The vector is then used to transform an appropriate host cell. Suitable recombinant expression systems include, but are not limited to, bacterial, mammalian, baculovirus/insect, vaccinia, Semliki Forest virus (SFV), Alphaviruses (such as, Sindbis, Venezuelan Equine Encephalitis (VEE)), mammalian, yeast and Xenopus expression systems, well known in the art. Particularly preferred expression systems are mammalian cell lines, vaccinia, Sindbis, eucaryotic layered vector initiation systems (e.g., U.S. Pat. No. 6,015,686, U.S. Pat. No. 5, 814,482, U.S. Pat. No. 6,015,694, U.S. Pat. No. 5,789,245, EP 1029068A2, WO 9918226A2/A3, EP 00907746A2, WO 9738087A2, all herein incorporated by reference in their entireties), insect and yeast systems.

The synthetic DNA fragments for the expression cassettes of the present invention, e.g., Pol, Gag, Env, Tat, Rev, Nef, Vif, Vpr, and/or Vpu, may be cloned into the following eucaryotic expression vectors: pCMVKm2, for transient expression assays and DNA immunization studies, the pCMVKm2 vector is derived from pCMV6a (Chapman et al., *Nuc. Acids Res.* (1991) 19:3979–3986) and comprises a kanamycin selectable marker, a ColE1 origin of replication, a CMV promoter enhancer and Intron A, followed by an insertion site for the synthetic sequences described below followed by a polyadenylation signal derived from bovine growth hormone—the pCMVKm2 vector differs from the pCMV-link vector only in that a polylinker site is inserted into pCMVKm2 to generate pCMV-link; pESN2dhfr and pCMVPLEdhfr, for expression in Chinese Hamster Ovary (CHO) cells; and, pAcC13, a shuttle vector for use in the Baculovirus expression system (pAcC13, is derived from pAcC12 which is described by Munemitsu S., et al., *Mol Cell Biol.* 10(11):5977–5982, 1990).

Briefly, construction of pCMVPLEdhfr was as follows.

To construct a DHFR cassette, the EMCV IRES (internal ribosome entry site) leader was PCR-amplified from pCite-4a+(Novagen, Inc., Milwaukee, Wis.) and inserted into pET-23d (Novagen, Inc., Milwaukee, Wis.) as an Xba-Nco fragment to give pET-EMCV. The dhfr gene was PCR-amplified from pESN2dhfr to give a product with a Gly-Gly-Gly-Ser spacer in place of the translation stop codon and inserted as an Nco-BamH 1 fragment to give pET-E-DHFR. Next, the attenuated neo gene was PCR amplified from a pSV2Neo (Clontech, Palo Alto, Calif.) derivative and inserted into the unique BamH 1 site of pET-E-DHFR to give pET-E-DHFRINeo$_{(m2)}$. Finally the bovine growth hormone terminator from pcDNA3 (Invitrogen, Inc., Carlsbad, Calif.) was inserted downstream of the neo gene to give pET-E-DHFR/Neo$_{(m2)}$BGHt. The EMCV-dhfr/neo selectable marker cassette fragment was prepared by cleavage of pET-E-DHFR/Neo$_{(m2)}$BGHt.

In one vector construct the CMV enhancer/promoter plus Intron A was transferred from pCMV6a (Chapman et al., Nuc. Acids Res. (1991) 19:3979–3986) as a HindIII-Sal1 fragment into pUC19 (New England Biolabs, Inc., Beverly, Mass.). The vector backbone of pUC19 was deleted from the Nde1 to the Sap1 sites. The above described DHFR cassette was added to the construct such that the EMCV IRES followed the CMV promoter. The vector also contained an ampr gene and an SV40 origin of replication.

A number of mammalian cell lines are known in the art and include immortalized cell lines available from the American Type Culture Collection (A.T.C.C.), such as, but not limited to, Chinese hamster ovary (CHO) cells, HeLa cells, baby hamster kidney (BHK) cells, monkey kidney cells (COS), as well as others. Similarly, bacterial hosts such as *E. coli, Bacillus subtilis*, and *Streptococcus* spp., will find use with the present expression constructs. Yeast hosts useful in the present invention include inter alia, *Saccharomyces cerevisiae, Candida albicans, Candida maltosa, Hansenula polymorpha, Kluyveromyces fragilis, Kluyveromyces lactis, Pichia guillerimondii, Pichia pastoris, Schizosaccharomyces pombe* and *Yarrowia lipolytica*. Insect cells for use with baculovirus expression vectors include, inter alia, *Aedes aegypti, Autographa californica, Bombyx mori, Drosophila melanogaster, Spodoptera frugiperda*, and *Trichoplusia ni*. See, e.g., Summers and Smith, *Texas Agricultural Experiment Station Bulletin No.* 1555 (1987).

Viral vectors can be used for the production of particles in eucaryotic cells, such as those derived from the pox family of viruses, including vaccinia virus and avian poxyirus. Additionally, a vaccinia based infection/transfection system, as described in Tomei et al., *J. Virol.* (1993) 67:4017–4026 and Selby et al., *J. Gen. Virol.* (1993) 74:1103–1113, will also find use with the present invention. In this system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the DNA of interest, driven by a T7 promoter. The polymerase expressed in the cytoplasm from the vaccinia virus recombinant transcribes the transfected DNA into RNA which is then translated into protein by the host translational machinery. Alternately, T7 can be added as a purified protein or enzyme as in the "Progenitor" system (Studier and Moffatt, *J. Mol. Biol.* (1986) 189:113–130). The method provides for high level, transient, cytoplasmic production of large quantities of RNA and its translation product(s).

Depending on the expression system and host selected, the VLPS are produced by growing host cells transformed by an expression vector under conditions whereby the particle-forming polypeptide is expressed and VLPs can be formed. The selection of the appropriate growth conditions is within the skill of the art. If the VLPs are formed intracellularly, the cells are then disrupted, using chemical, physical or mechanical means, which lyse the cells yet keep the VLPs substantially intact. Such methods are known to those of skill in the art and are described in, e.g., *Protein Purification Applications: A Practical Approach*, (E. L. V. Harris and S. Angal, Eds., 1990).

The particles are then isolated (or substantially purified) using methods that preserve the integrity thereof, such as, by gradient centrifugation, e.g., cesium chloride (CsCl) sucrose gradients, pelleting and the like (see, e.g., Kirnbauer et al. *J. Virol.* (1993) 67:6929–6936), as well as standard purification techniques including, e.g., ion exchange and gel filtration chromatography.

VLPs produced by cells containing the synthetic expression cassettes of the present invention can be used to elicit an immune response when administered to a subject. One advantage of the present invention is that VLPs can be produced by mammalian cells carrying the synthetic expression cassettes at levels previously not possible. As discussed above, the VLPs can comprise a variety of antigens in addition to the Gag polypeptide (e.g., Gag-protease, Gag-polymerase, Env, synthetic Env, etc.). Purified VLPs, produced using the synthetic expression cassettes of the present invention, can be administered to a vertebrate subject, usually in the form of vaccine compositions. Combination vaccines may also be used, where such vaccines contain, for example, an adjuvant subunit protein (e.g., Env). Administration can take place using the VLPs formulated alone or formulated with other antigens. Further, the VLPs can be administered prior to, concurrent with, or subsequent to, delivery of the synthetic expression cassettes for DNA immunization (see below) and/or delivery of other vaccines. Also, the site of VLP administration may be the same or different as other vaccine compositions that are being administered. Gene delivery can be accomplished by a number of methods including, but are not limited to, immunization with DNA, alphavirus vectors, pox virus vectors, and vaccinia virus vectors.

VLP immune-stimulating (or vaccine) compositions can include various excipients, adjuvants, carriers, auxiliary substances, modulating agents, and the like. The immune stimulating compositions will include an amount of the VLP/antigen sufficient to mount an immunological response. An appropriate effective amount can be determined by one of skill in the art. Such an amount will fall in a relatively broad range that can be determined through routine trials and will generally be an amount on the order of about 0.1 μg to about 1000 μg, more preferably about 1 μg to about 300 μg, of VLP/antigen.

A carrier is optionally present which is a molecule that does not itself induce the production of antibodies harmful to the individual receiving the composition. Suitable carriers are typically large, slowly metabolized macromolecules such as proteins, polysaccharides, polylactic acids, polyglycollic acids, polymeric amino acids, amino acid copolymers, lipid aggregates (such as oil droplets or liposomes), and inactive virus particles. Examples of particulate carriers include those derived from polymethyl methacrylate polymers, as well as microparticles derived from poly(lactides) and poly(lactide-co-glycolides), known as PLG. See, e.g., Jeffery et al., *Pharm. Res.* (1993) 10:362–368; McGee JP, et al., *J Microencapsul.* 14(2):197–210, 1997; O'Hagan DT, et al., *Vaccine* 11(2):149–54, 1993. Such carriers are well known to those of ordinary skill in the art. Additionally, these carriers may function as immunostimulating agents ("adjuvants"). Furthermore, the antigen may be conjugated to a bacterial toxoid, such as toxoid from diphtheria, tetanus, cholera, etc., as well as toxins derived from *E. coli.*

Adjuvants may also be used to enhance the effectiveness of the compositions. Such adjuvants include, but are not limited to: (1) aluminum salts (alum), such as aluminum hydroxide, aluminum phosphate, aluminum sulfate, etc.; (2) oil-in-water emulsion formulations (with or without other specific immunostimulating agents such as muramyl peptides (see below) or bacterial cell wall components), such as for example (a) MF59 (International Publication No. WO 90/14837), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+ CWS (Detox™); (3) saponin adjuvants, such as Stimulon™ (Cambridge Bioscience, Worcester, Mass.) may be used or particle generated therefrom such as ISCOMs (immunostimulating complexes); (4) Complete Freunds Adjuvant (CFA) and Incomplete Freunds Adjuvant (IFA); (5) cytokines, such as interleukins (IL-1, IL-2, etc.), macrophage colony stimulating factor (M-CSF), tumor necrosis factor (TNF), etc.; (6) oligonucleotides or polymeric molecules encoding immunostimulatory CpG mofifs (Davis, H. L., et al., *J. Immunology* 160:870–876, 1998; Sato, Y. et al., *Science* 273:352–354, 1996) or complexes of antigens/oligonucleotides {Polymeric molecules include double and single stranded RNA and DNA, and backbone modifications thereof, for example, methylphosphonate linkages; or (7) detoxified mutants of a bacterial ADP-ribosylating toxin such as a cholera toxin (CT), a pertussis toxin (PT), or an *E. coli* heat-labile toxin (LT), particularly LT-K63 (where lysine is substituted for the wild-type amino acid at position 63) LT-R72 (where arginine is substituted for the wild-type amino acid at position 72), CT-S109 (where serine is substituted for the wild-type amino acid at position 109), and PT-K9/G129 (where lysine is substituted for the wild-type amino acid at position 9 and glycine substituted at position 129) (see, e.g., International Publication Nos. WO93/13202 and WO92/19265); and (8) other substances that act as immunostimulating agents to enhance the effectiveness of the composition. Further, such polymeric molecules include alternative polymer backbone structures such as, but not limited to, polyvinyl backbones (Pitha, *Biochem Biophys Acta*, 204:39, 1970a; Pitha, *Biopolymers*, 9:965, 1970b), and morpholino backbones (Summerton, J., et al., U.S. Pat. No. 5,142,047, issued Aug. 25, 1992; Summerton, J., et al., U.S. Pat. No. 5,185,444 issued Feb. 9, 1993). A variety of other charged and uncharged polynucleotide analogs have been reported. Numerous backbone modifications are known in the art, including, but not limited to, uncharged linkages (e.g., methyl phosphonates, phosphotriesters, phosphoamidates, and carbamates) and charged linkages (e.g., phosphorothioates and phosphorodithioates).}; and (7) other substances that act as immunostimulating agents to enhance the effectiveness of the VLP immune-stimulating (or vaccine) composition. Alum, CpG oligonucleotides, and MF59 are preferred.

Muramyl peptides include, but are not limited to, N-acetyl-muramyl-L-threonyl-D-isoglutamine (thr-MDP), N-acteyl-normuramyl-L-alanyl-D-isogluatme (nor-MDP), N-acetylmuramyl-L-alanyl-D-isogluatminyl-L-alanine-2-(1'-2'-dipalmitoyl-sn-glycero-3-huydroxyphosphoryloxy)-ethylamine (MTP-PE), etc.

Dosage treatment with the VLP composition may be a single dose schedule or a multiple dose schedule. A multiple dose schedule is one in which a primary course of vaccination may be with 1–10 separate doses, followed by other doses given at subsequent time intervals, chosen to maintain and/or reinforce the immune response, for example at 1–4 months for a second dose, and if needed, a subsequent dose(s) after several months. The dosage regimen will also, at least in part, be determined by the need of the subject and be dependent on the judgment of the practitioner.

If prevention of disease is desired, the antigen carrying VLPs are generally administered prior to primary infection with the pathogen of interest. If treatment is desired, e.g., the reduction of symptoms or recurrences, the VLP compositions are generally administered subsequent to primary infection.

2.3.2 Using the Synthetic Expression Cassettes of the Present Invention to Create Packaging Cell Lines A number of viral based systems have been developed for use as gene transfer vectors for mammalian host cells. For example, retroviruses (in particular, lentiviral vectors) provide a convenient platform for gene delivery systems. A coding sequence of interest (for example, a sequence useful for gene therapy applications) can be inserted into a gene delivery vector and packaged in retroviral particles using techniques known in the art. Recombinant virus can then be isolated and delivered to cells of the subject either in vivo or ex vivo. A number of retroviral systems have been described, including, for example, the following: (U.S. Pat. No. 5,219,740; Miller et al. (1989) *BioTechniques* 7:980; Miller, A. D. (1990) *Human Gene Therapy* 1:5; Scarpa et al. (1991) *Virology* 180:849; Burns et al. (1993) *Proc. Natl. Acad. Sci. USA* 90:8033; Boris-Lawrie et al. (1993) *Cur. Opin. Genet. Develop.* 3:102; GB 2200651; EP 0415731; EP 0345242; WO 89/02468; WO 89/05349; WO 89/09271; WO 90/02806; WO 90/07936; WO 90/07936; WO 94/03622; WO 93/25698; WO 93/25234; WO 93/11230; WO 93/10218; WO 91/02805; in U.S. Pat. No. 5,219,740; U.S. Pat. No. 4,405,712; U.S. Pat. No. 4,861,719; U.S. Pat. No. 4,980,289 and U.S. Pat. No. 4,777,127; in U.S. Ser. No. 07/800,921; and in Vile (1993) *Cancer Res* 53:3860–3864; Vile (1993) *Cancer Res* 53:962–967; Ram (1993) *Cancer Res* 53:83–88; Takamiya (1992) *J Neurosci Res* 33:493–503; Baba (1993) *J Neurosurg* 79:729–735; Mann (1983) *Cell* 33:153; Cane (1984) *Proc Natl Acad Sci USA* 81;6349; and Miller (1990) *Human Gene Therapy* 1.

In other embodiments, gene transfer vectors can be constructed to encode a cytokine or other immunomodulatory molecule. For example, nucleic acid sequences encoding native IL-2 and gamma-interferon can be obtained as described in U.S. Pat. Nos. 4,738,927 and 5,326,859, respectively, while useful muteins of these proteins can be obtained as described in U.S. Pat. No. 4,853,332. Nucleic acid sequences encoding the short and long forms of mCSF can be obtained as described in U.S. Pat. Nos. 4,847,201 and 4,879,227, respectively. In particular aspects of the invention, retroviral vectors expressing cytokine or immunomodulatory genes can be produced as described herein (for example, employing the packaging cell lines of the present invention) and in International Application No. PCT US 94/02951, entitled "Compositions and Methods for Cancer Immunotherapy."

Examples of suitable immunomodulatory molecules for use herein include the following: IL-1 and IL-2 (Karupiah et al. (1990) *J. Immunology* 144:290–298, Weber et al. (1987) *J. Exp. Med.* 166:1716–1733, Gansbacher et al. (1990) *J. Exp. Med.* 172:1217–1224, and U.S. Pat. No. 4,738,927); IL-3 and IL-4 (Tepper et al. (1989) *Cell* 57:503–512, Golumbek et al. (1991) *Science* 254:713–716, and U.S. Pat. No. 5,017,691); IL-5 and IL-6 (Brakenhof et al. (1987) *J. Immunol.* 139:4116–4121, and International Publication No. WO 90/06370); IL-7 (U.S. Pat. No. 4,965,195); IL-8, IL-9, IL-10, IL-11, IL-12, and IL-13 (*Cytokine Bulletin, Summer* 1994); IL-14 and IL-15; alpha interferon (Finter et al. (1991) *Drugs* 42:749–765, U.S. Pat. Nos. 4,892,743 and 4,966,843, International Publication No. WO 85/02862, Nagata et al. (1980) *Nature* 284:316–320, Familletti et al. (1981) Methods in Enz. 78:387–394, Twu et al. (1989) *Proc. Natl. Acad. Sci. USA* 86:2046–2050, and Faktor et al. (1990) *Oncogene* 5:867–872); beta-interferon (Seif et al. (1991) *J. Virol.* 65:664–671); gamma-interferons (Radford et al. (1991) *The American Society of Hepatology* 20082015, Watanabe et al. (1989) *Proc. Natl. Acad. Sci. USA* 86:9456–9460, Gansbacher et al. (1990) *Cancer Research* 50:7820–7825, Maio et al. (1989) *Can. Immunol. Immunother.* 30:34–42, and U.S. Pat. Nos. 4,762,791 and 4,727,138); G-CSF (U.S. Pat. Nos. 4,999,291 and 4,810,643); GM-CSF (International Publication No. WO 85/04188).

Immunomodulatory factors may also be agonists, antagonists, or ligands for these molecules. For example, soluble forms of receptors can often behave as antagonists for these types of factors, as can mutated forms of the factors themselves.

Nucleic acid molecules that encode the above-described substances, as well as other nucleic acid molecules that are advantageous for use within the present invention, may be readily obtained from a variety of sources, including, for example, depositories such as the American Type Culture Collection, or from commercial sources such as British Bio-Technology Limited (Cowley, Oxford England). Representative examples include BBG 12 (containing the GM-CSF gene coding for the mature protein of 127 amino acids), BBG 6 (which contains sequences encoding gamma interferon), A.T.C.C. Deposit No. 39656 (which contains sequences encoding TNF), A.T.C.C. Deposit No. 20663 (which contains sequences encoding alpha-interferon), A.T.C.C. Deposit Nos. 31902, 31902 and 39517 (which contain sequences encoding beta-interferon), A.T.C.C. Deposit No. 67024 (which contains a sequence which encodes Interleukin-1b), A.T.C.C. Deposit Nos. 39405, 39452, 39516, 39626 and 39673 (which contain sequences encoding Interleukin-2), A.T.C.C. Deposit Nos. 59399, 59398, and 67326 (which contain sequences encoding Interleukin-3), A.T.C.C. Deposit No. 57592 (which contains sequences encoding Interleukin-4), A.T.C.C. Deposit Nos. 59394 and 59395 (which contain sequences encoding Interleukin-5), and A.T.C.C. Deposit No. 67153 (which contains sequences encoding Interleukin-6).

Plasmids containing cytokine genes or immunomodulatory genes (International Publication Nos. WO 94/02951 and WO 96/21015, both of which are incorporated by reference in their entirety)can be digested with appropriate restriction enzymes, and DNA fragments containing the particular gene of interest can be inserted into a gene transfer vector using standard molecular biology techniques. (See, e.g., Sambrook et al., supra., or Ausbel et al. (eds) *Current Protocols in Molecular Biology*, Greene Publishing and Wiley-Interscience).

Polynucleotide sequences coding for the above-described molecules can be obtained using recombinant methods, such as by screening cDNA and genomic libraries from cells expressing the gene, or by deriving the gene from a vector known to include the same. For example, plasmids which contain sequences that encode altered cellular products may be obtained from a depository such as the A.T.C.C., or from commercial sources. Plasmids containing the nucleotide sequences of interest can be digested with appropriate restriction enzymes, and DNA fragments containing the nucleotide sequences can be inserted into a gene transfer vector using standard molecular biology techniques.

Alternatively, cDNA sequences for use with the present invention may be obtained from cells which express or contain the sequences, using standard techniques, such as phenol extraction and PCR of cDNA or genomic DNA. See, e.g., Sambrook et al., supra, for a description of techniques used to obtain and isolate DNA. Briefly, mRNA from a cell which expresses the gene of interest can be reverse transcribed with reverse transcriptase using oligo-dT or random primers. The single stranded cDNA may then be amplified by PCR (see U.S. Pat. Nos. 4,683,202, 4,683,195 and 4,800,159, see also *PCR Technology: Principles and Applications for DNA Amplification*, Erlich (ed.), Stockton Press, 1989)) using oligonucleotide primers complementary to sequences on either side of desired sequences.

The nucleotide sequence of interest can also be produced synthetically, rather than cloned, using a DNA synthesizer (e.g., an Applied Biosystems Model 392 DNA Synthesizer, available from ABI, Foster City, Calif.). The nucleotide sequence can be designed with the appropriate codons for the expression product desired. The complete sequence is assembled from overlapping oligonucleotides prepared by standard methods and assembled into a complete coding sequence. See, e.g., Edge (1981) *Nature* 292:756; Nambair et al. (1984) *Science* 223:1299; Jay et al. (1984) *J. Biol. Chem.* 259:6311.

The synthetic expression cassettes of the present invention can be employed in the construction of packaging cell lines for use with retroviral vectors.

One type of retrovirus, the murine leukemia virus, or "MLV", has been widely utilized for gene therapy applications (see generally Mann et al. (*Cell* 33:153, 1993), Cane and Mulligan (*Proc, Nat'l. Acad. Sci. USA* 81:6349, 1984), and Miller et al., *Human Gene Therapy* 1:5–14,1990.

Lentiviral vectors typically, comprise a 5' lentiviral LTR, a tRNA binding site, a packaging signal, a promoter operably linked to one or more genes of interest, an origin of second strand DNA synthesis and a 3' lentiviral LTR, wherein the lentiviral vector contains a nuclear transport element. The nuclear transport element may be located either upstream (5') or downstream (3') of a coding sequence of interest (for example, a synthetic Gag or Env expression cassette of the present invention). Within certain embodiments, the nuclear transport element is not RRE. Within one embodiment the packaging signal is an extended packaging signal. Within other embodiments the promoter is a tissue specific promoter, or, alternatively, a promoter such as CMV. Within other embodiments, the lentiviral vector further comprises an internal ribosome entry site.

A wide variety of lentiviruses may be utilized within the context of the present invention, including for example, lentiviruses selected from the group consisting of HIV, HIV-1, HIV-2, FIV and SIV.

Within yet another aspect of the invention, host cells (e.g., packaging cell lines) are provided which contain any of the expression cassettes described herein. For example, within one aspect packaging cell line are provided comprising an expression cassette that comprises a sequence encoding synthetic Gag-polymerase, and a nuclear transport element, wherein the promoter is operably linked to the sequence encoding Gag-polymerase. Packaging cell lines may further comprise a promoter and a sequence encoding tat, rev, or an envelope, wherein the promoter is operably linked to the sequence encoding tat, rev, Env or sequences encoding modified versions of these proteins. The packaging cell line may further comprise a sequence encoding any one or more of other HIV gene encoding sequences.

In one embodiment, the expression cassette (carrying, for example, the synthetic Gag-polymerase) is stably integrated. The packaging cell line, upon introduction of a lentiviral vector, typically produces particles. The promoter regulating expression of the synthetic expression cassette may be inducible. Typically, the packaging cell line, upon introduction of a lentiviral vector, produces particles that are essentially free of replication competent virus.

Packaging cell lines are provided comprising an expression cassette which directs the expression of a synthetic Gag-polymerase gene or comprising an expression cassette which directs the expression of a synthetic Env genes described herein. (See, also, Andre, S., et al., *Journal of Virology* 72(2):1497–1503, 1998; Haas, J., et al., *Current Biology* 6(3):315–324, 1996) for a description of other modified Env sequences). A lentiviral vector is introduced into the packaging cell line to produce a vector producing cell line.

As noted above, lentiviral vectors can be designed to carry or express a selected gene(s) or sequences of interest. Lentiviral vectors may be readily constructed from a wide variety of lentiviruses (see RNA Tumor Viruses, Second Edition, Cold Spring Harbor Laboratory, 1985). Representative examples of lentiviruses included HIV, HIV-1, HIV-2, FIV and SIV. Such lentiviruses may either be obtained from patient isolates, or, more preferably, from depositories or collections such as the American Type Culture Collection, or isolated from known sources using available techniques.

Portions of the lentiviral gene delivery vectors (or vehicles) may be derived from different viruses. For example, in a given recombinant lentiviral vector, LTRs may be derived from an HIV, a packaging signal from SIV, and an origin of second strand synthesis from HrV-2. Lentiviral vector constructs may comprise a 5' lentiviral LTR, a tRNA binding site, a packaging signal, one or more heterologous sequences, an origin of second strand DNA synthesis and a 3' LTR, wherein said lentiviral vector contains a nuclear transport element that is not RRE.

Briefly, Long Terminal Repeats ("LTRs") are subdivided into three elements, designated U5, R and U3. These elements contain a variety of signals which are responsible for the biological activity of a retrovirus, including for example, promoter and enhancer elements which are located within U3. LTRs may be readily identified in the provirus (integrated DNA form) due to their precise duplication at either end of the genome. As utilized herein, a 5' LTR should be understood to include a 5' promoter element and sufficient LTR sequence to allow reverse transcription and integration of the DNA form of the vector. The 3' LTR should be understood to include a polyadenylation signal, and sufficient LTR sequence to allow reverse transcription and integration of the DNA form of the vector.

The tRNA binding site and origin of second strand DNA synthesis are also important for a retrovirus to be biologically active, and may be readily identified by one of skill in the art. For example, retroviral tRNA binds to a tRNA binding site by Watson-Crick base pairing, and is carried with the retrovirus genome into a viral particle. The tRNA is then utilized as a primer for DNA synthesis by reverse transcriptase. The tRNA binding site may be readily identified based upon its location just downstream from the 5'LTR. Similarly, the origin of second strand DNA synthesis is, as its name implies, important for the second strand DNA synthesis of a retrovirus. This region, which is also referred to as the poly-purine tract, is located just upstream of the 3'LTR.

In addition to a 5' and 3' LTR, tRNA binding site, and origin of second strand DNA synthesis, recombinant retroviral vector constructs may also comprise a packaging signal, as well as one or more genes or coding sequences of interest. In addition, the lentiviral vectors have a nuclear transport element which, in preferred embodiments is not RRE. Representative examples of suitable nuclear transport elements include the element in Rous sarcoma virus (Ogert, et al., *J. Virol.* 70, 3834–3843, 1996), the element in Rous sarcoma virus (Liu & Mertz, *Genes & Dev.*, 9, 1766–1789, 1995) and the element in the genome of simian retrovirus type I (Zolotukhin, et al., *J. Virol.* 68, 7944–7952, 1994). Other potential elements include the elements in the histone gene (Kedes, *Annu. Rev. Biochem.* 48, 837–870, 1970), the α-interferon gene (Nagata et al., *Nature* 287, 401–408, 1980), the β-adrenergic receptor gene (Koilka, et al., *Nature* 329, 75–79, 1987), and the c-Jun gene (Hattorie, et al., *Proc. Natl. Acad. Sci. USA* 85, 9148–9152, 1988).

Recombinant lentiviral vector constructs typically lack both Gag-polymerase and Env coding sequences. Recombinant lentiviral vector typically contain less than 20, preferably 15, more preferably 10, and most preferably 8 consecutive nucleotides found in Gag-polymerase and Env genes. One advantage of the present invention is that the synthetic Gag-polymerase expression cassettes, which can be used to construct packaging cell lines for the recombinant retroviral vector constructs, have little homology to wild-type Gag-polymerase sequences and thus considerably reduce or eliminate the possibility of homologous recombination between the synthetic and wild-type sequences.

Lentiviral vectors may also include tissue-specific promoters to drive expression of one or more genes or sequences of interest.

Lentiviral vector constructs may be generated such that more than one gene of interest is expressed. This may be accomplished through the use of di- or oligo-cistronic cassettes (e.g., where the coding regions are separated by 80 nucleotides or less, see generally Levin et al., *Gene* 108: 167–174, 1991), or through the use of Internal Ribosome Entry Sites ("IRES").

Packaging cell lines suitable for use with the above described recombinant retroviral vector constructs may be readily prepared given the disclosure provided herein. Briefly, the parent cell line from which the packaging cell line is derived can be selected from a variety of mammalian cell lines, including for example, 293, RD, COS-7, CHO, BHK, VERO, HT1080, and myeloma cells.

After selection of a suitable host cell for the generation of a packaging cell line, one or more expression cassettes are introduced into the cell line in order to complement or supply in trans components of the vector which have been deleted.

Representative examples of suitable synthetic HIV polynucleotide sequences have been described herein for use in expression cassettes of the present invention. As described above, the native and/or synthetic coding sequences may also be utilized in these expression cassettes.

Utilizing the above-described expression cassettes, a wide variety of packaging cell lines can be generated. For example, within one aspect packaging cell line are provided comprising an expression cassette that comprises a sequence encoding synthetic Gag-polymerase, and a nuclear transport element, wherein the promoter is operably linked to the sequence encoding Gag-polymerase. Within other aspects, packaging cell lines are provided comprising a promoter and a sequence encoding tat, rev, Env, or other HIV antigens or epitopes derived therefrom, wherein the promoter is operably linked to the sequence encoding tat, rev, Env, or the HIV antigen or epitope. Within further embodiments, the packaging cell line may comprise a sequence encoding any one or more of tat, rev, nef, vif, vpu or vpr. For example, the packaging cell line may contain only tat, rev, nef, vif, vpu, or vpr alone, tat rev and nef, nef and vif, nef and vpu, nef and vpr, vif and vpu, vif and vpr, vpu and vpr, nef vif and vpu, nef vif and vpr, nef vpu and vpr, vif vpu and vpr, all four of nef, vif, vpu, and vpr, etc.

In one embodiment, the expression cassette is stably integrated. Within another embodiment, the packaging cell line, upon introduction of a lentiviral vector, produces particles. Within further embodiments the promoter is inducible. Within certain preferred embodiments of the invention, the packaging cell line, upon introduction of a lentiviral vector, produces particles that are free of replication competent virus.

The synthetic cassettes containing modified coding sequences are transfected into a selected cell line. Transfected cells are selected that (i) carry, typically, integrated, stable copies of the HIV coding sequences, and (ii) are expressing acceptable levels of these polypeptides (expression can be evaluated by methods known in the prior art in view of the teachings of the present disclosure). The ability of the cell line to produce VLPs may also be verified.

A sequence of interest is constructed into a suitable viral vector as discussed above. This defective virus is then transfected into the packaging cell line. The packaging cell line provides the viral functions necessary for producing virus-like particles into which the defective viral genome, containing the sequence of interest, are packaged. These VLPs are then isolated and can be used, for example, in gene delivery or gene therapy.

Further, such packaging cell lines can also be used to produce VLPs alone, which can, for example, be used as adjuvants for administration with other antigens or in vaccine compositions. Also, co-expression of a selected sequence of interest encoding a polypeptide (for example, an antigen) in the packaging cell line can also result in the entrapment and/or association of the selected polypeptide in/with the VLPs.

Various forms of the different embodiments of the present invention (e.g., synthetic constructs) may be combined.

2.4.0 DNA Immunization and Gene Delivery

A variety of HIV polypeptide antigens, particularly HIV antigens, can be used in the practice of the present invention. HIV antigens can be included in DNA immunization constructs containing, for example, a synthetic Env expression cassettes, a synthetic Gag expression cassette, a synthetic pol-derived polypeptide expression cassette, a synthetic expression cassette comprising sequences encoding one or more accessory or regulatory genes (e.g., tat, rev, nef, vif, vpu, vpr), and/or a synthetic Gag expression cassette fused in-frame to a coding sequence for the polypeptide antigen (synthetic or wild-type), where expression of the construct results in VLPs presenting the antigen of interest.

HIV antigens of particular interest to be used in the practice of the present invention include pol, tat, rev, nef, vif, vpu, vpr, and other HIV-1 (also known as HTLV-III, LAV, ARV, etc.) antigens or epitopes derived therefrom, including, but not limited to, antigens such as gp120, gp41, gp160 (both native and modified); Gag; and pol from a variety of isolates including, but not limited to, $HIV_{IIIb}$, $HIV_{SF2}$, $HIV-1_{SF162}$, $HIV-1_{SF170}$, $HIV_{LAV}$, $HIV_{LAI}$, $HIV_{MN}$, $HIV-1_{CM235}$, , $HIV-1_{US4}$, other HIV-1 strains from diverse subtypes (e.g., subtypes, A through G, and O), HIV-2 strains and diverse subtypes (e.g., $HIV-2_{UC1}$ and $HIV-2_{UC2}$). See, e.g., Myers, et al., Los Alamos Database, Los Alamos National Laboratory, Los Alamos, N. Mex.; Myers, et al., *Human Retroviruses and Aids*, 1990, Los Alamos, N. Mex.: Los Alamos National Laboratory. These antigens may be synthetic (as described herein) or wild-type.

To evaluate efficacy, DNA immunization using synthetic expression cassettes of the present invention can be performed, for example, as follows. Mice are immunized with a tat/rev/nef synthetic expression cassette. Other mice are immunized with a tat/rev/nef wild type expression cassette. Mouse immunizations with plasmid-DNAs typically show that the synthetic expression cassettes provide a clear improvement of immunogenicity relative to the native expression cassettes. Also, a second boost immunization will induce a secondary immune response, for example, after approximately two weeks. Further, the results of CTL assays typically show increased potency of synthetic expression cassettes for induction of cytotoxic T-lymphocyte (CTL) responses by DNA immunization.

Exemplary primate studies directed at the evaluation of neutralizing antibodies and cellular immune responses against HIV are described below.

It is readily apparent that the subject invention can be used to mount an immune response to a wide variety of antigens and hence to treat or prevent infection, particularly HIV infection.

2.4.1 Delivery of the Synthetic Expression Cassettes of the Present Invention

Polynucleotide sequences coding for the above-described molecules can be obtained using recombinant methods, such as by screening cDNA and genomic libraries from cells expressing the gene, or by deriving the gene from a vector known to include the same. Furthermore, the desired gene can be isolated directly from cells and tissues containing the same, using standard techniques, such as phenol extraction and PCR of cDNA or genomic DNA. See, e.g., Sambrook et al., supra, for a description of techniques used to obtain and isolate DNA. The gene of interest can also be produced synthetically, rather than cloned. The nucleotide sequence can be designed with the appropriate codons for the particular amino acid sequence desired. In general, one will select preferred codons for the intended host in which the sequence will be expressed. The complete sequence is assembled from overlapping oligonucleotides prepared by standard methods and assembled into a complete coding sequence. See, e.g., Edge, *Nature* (1981) 292:756; Nambair et al., *Science* (1984) 223:1299; Jay et al., *J. Biol. Chem.* (1984) 259:6311; Stemmer, W. P. C., (1995) *Gene* 164: 49–53.

Next, the gene sequence encoding the desired antigen can be inserted into a vector containing a synthetic expression cassette of the present invention. In one embodiment, polynucleotides encoding selected antigens are separately cloned into expression vectors (e.g., Env-coding polynucleotide in a first vector, Gag-coding polynucleotide in a second vector, Pol-derived polypeptide-coding polynucleotide in a third vector, tat-, rev-, nef-, vif-, vpu-, vpr-coding polynucleotides in further vectors, etc.). In certain embodiments, the antigen is inserted into or adjacent a synthetic Gag coding sequence such that when the combined sequence is expressed it results in the production of VLPs comprising the Gag polypeptide and the antigen of interest, e.g., Env (native or modified) or other antigen(s) (native or modified) derived from HIV. Insertions can be made within the coding sequence or at either end of the coding sequence (5', amino terminus of the expressed Gag polypeptide; or 3', carboxy terminus of the expressed Gag polypeptide)(Wagner, R., et al., Arch Virol. 127:117–137, 1992; Wagner, R., et al., Virology 200:162–175, 1994; Wu, X., et al., J. Virol. 69(6):3389–3398, 1995; Wang, C-T., et al., Virology 200: 524–534, 1994; Chazal, N., et al., Virology 68(1):111–122, 1994; Griffiths, J. C., et al., J. Virol. 67(6):3191–3198, 1993; Reicin, A. S., et al., J. Virol. 69(2):642–650, 1995).

Up to 50% of the coding sequences of p55Gag can be deleted without affecting the assembly to virus-like particles and expression efficiency (Borsetti, A., et al, J. Virol. 72(11): 9313–9317, 1998; Garnier, L., et al., J Virol 72(6):4667–4677, 1998; Zhang, Y., et al., J Virol 72(3): 1782–1789, 1998; Wang, C., et al., J Virol 72(10): 7950–7959, 1998). In one embodiment of the present invention, immunogenicity of the high level expressing synthetic Gag expression cassettes can be increased by the insertion of different structural or non-structural HIV antigens, multi-epitope cassettes, or cytokine sequences into deleted regions of Gag sequence. Such deletions may be generated following the teachings of the present invention and information available to one of ordinary skill in the art. One possible advantage of this approach, relative to using full-length sequences fused to heterologous polypeptides, can be higher expression/secretion efficiency of the expression product.

When sequences are added to the amino terminal end of Gag, the polynucletide can contain coding sequences at the 5' end that encode a signal for addition of a myristic moiety to the Gag-containing polypeptide (e.g., sequences that encode Met-Gly).

The ability of Gag-containing polypeptide constructs to form VLPs can be empirically determined following the teachings of the present specification.

The synthetic expression cassettes can also include control elements operably linked to the coding sequence, which allow for the expression of the gene in vivo in the subject species. For example, typical promoters for mammalian cell expression include the SV40 early promoter, a CMV promoter such as the CMV immediate early promoter, the mouse mammary tumor virus LTR promoter, the adenovirus major late promoter (Ad MLP), and the herpes simplex virus promoter, among others. Other nonviral promoters, such as a promoter derived from the murine metallothionein gene, will also find use for mammalian expression. Typically, transcription termination and polyadenylation sequences will also be present, located 3' to the translation stop codon. Preferably, a sequence for optimization of initiation of translation, located 5' to the coding sequence, is also present.

Examples of transcription terminator/polyadenylation signals include those derived from SV40, as described in Sambrook et al., supra, as well as a bovine growth hormone terminator sequence.

Enhancer elements may also be used herein to increase expression levels of the mammalian constructs. Examples include the SV40 early gene enhancer, as described in Dijkema et al., EMBO J. (1985) 4:761, the enhancer/promoter derived from the long terminal repeat (LTR) of the Rous Sarcoma Virus, as described in Gorman et al., Proc. Natl. Acad. Sci. USA (1982b) 79:6777 and elements derived from human CMV, as described in Boshart et al., Cell (1985) 41:521, such as elements included in the CMV intron A sequence.

Furthermore, plasmids can be constructed which include a chimeric antigen-coding gene sequences, encoding, e.g., multiple antigens/epitopes of interest, for example derived from more than one viral isolate.

Typically the antigen coding sequences precede or follow the synthetic coding sequence and the chimeric transcription unit will have a single open reading frame encoding both the antigen of interest and the synthetic coding sequences. Alternatively, multi-cistronic cassettes (e.g., bi-cistronic cassettes) can be constructed allowing expression of multiple antigens from a single mRNA using the EMCV IRES, or the like (Example 7).

In one embodiment of the present invention, a nucleic acid immunizing composition may comprise, for example, the following: a first expression vector comprising a Gag expression cassette, a second vector comprising an Env expression cassette, and a third expression vector comprising a Pol expression cassette, or one or more coding region of Pol (e.g., Prot, RT, RNase, Int), wherein further antigen coding sequences may be associated with the Pol expression, such antigens may be obtained, for example, from accessory genes (e.g., vpr, vpu, vif), regulatory genes (e.g., nef, tat, rev), or portions of the Pol sequences (e.g., Prot, RT, RNase, Int)). In another embodiment, a nucleic acid immunizing composition may comprise, for example, an expression cassette comprising any of the synthetic polynucleotide sequences of the present invention. In another embodiment, a nucleic acid immunizing composition may comprise, for example, an expression cassette comprising coding sequences for a number of HIV genes (or sequences derived from such genes) wherein the coding sequences are in-frame and under the control of a single promoter, for example, Gag-Env constructs, Tat-Rev-Nef constructs, P2Pol-tat-rev-nef constructs, etc. The synthetic coding sequences of the present invention may be combined in any number of combinations depending on the coding sequence products (i.e., HIV polypeptides) to which, for example, an immunological response is desired to be raised. In yet another embodiment, synthetic coding sequences for mulitple HIV-derived polypeptides may be constructed into a polycistronic message under the control of a single promoter wherein IRES are placed adjacent the coding sequence for each encoded polypeptide.

Once complete, the constructs are used for nucleic acid immunization using standard gene delivery protocols. Methods for gene delivery are known in the art. See, e.g., U.S. Pat. Nos. 5,399,346, 5,580,859, 5,589,466. Genes can be delivered either directly to the vertebrate subject or, alternatively, delivered ex vivo, to cells derived from the subject and the cells reimplanted in the subject.

A number of viral based systems have been developed for gene transfer into mammalian cells. For example, retroviruses provide a convenient platform for gene delivery systems. Selected sequences can be inserted into a vector and packaged in retroviral particles using techniques known in the art. The recombinant virus can then be isolated and delivered to cells of the subject either in vivo or ex vivo. A number of retroviral systems have been described (U.S. Pat. No. 5,219,740; Miller and Rosman, *BioTechniques* (1989) 7:980–990; Miller, A. D., *Human Gene Therapy* (1990) 1:5–14; Scarpa et al., *Virology* (1991) 180:849–852; Burns et al., *Proc. Natl. Acad. Sci. USA* (1993) 90:8033–8037; and Boris-Lawrie and Temin, *Cur. Opin. Genet. Develop.* (1993) 3:102–109.

A number of adenovirus vectors have also been described. Unlike retroviruses which integrate into the host genome, adenoviruses persist extrachromosomally thus minimizing the risks associated with insertional mutagenesis (Haj-Ahmad and Graham, *J. Virol.* (1986) 57:267–274; Bett et al., *J. Virol.* (1993) 67:5911–5921; Mittereder et al., *Human Gene Therapy* (1994) 5:717–729; Seth et al., *J. Virol.* (1994) 68:933–940; Barr et al., *Gene Therapy* (1994) 1:51–58; Berkner, K. L. *BioTechniques* (1988) 6:616–629; and Rich et al., *Human Gene Therapy* (1993) 4:461–476).

Additionally, various adeno-associated virus (AAV) vector systems have been developed for gene delivery. AAV vectors can be readily constructed using techniques well known in the art. See, e.g., U.S. Pat. Nos. 5,173,414 and 5,139,941; International Publication Nos. WO 92/01070 (published Jan. 23, 1992) and WO 93/03769 (published Mar. 4, 1993); Lebkowski et al., *Molec. Cell. Biol.* (1988) 8:3988–3996; Vincent et al., *Vaccines* 90 (1990) (Cold Spring Harbor Laboratory Press); Carter, B. J. *Current Opinion in Biotechnology* (1992) 3:533–539; Muzyczka, N. *Current Topics in Microbiol. and Immunol.* (1992) 158:97–129; Kotin, R. M. *Human Gene Therapy* (1994) 5:793–801; Shelling and Smith, *Gene Therapy* (1994) 1:165–169; and Zhou et al., *J. Exp. Med.* (1994) 179:1867–1875.

Another vector system useful for delivering the polynucleotides of the present invention is the enterically administered recombinant poxyirus vaccines described by Small, Jr., P. A., et al. (U.S. Pat. No. 5,676,950, issued Oct. 14, 1997, herein incorporated by reference).

Additional viral vectors which will find use for delivering the nucleic acid molecules encoding the antigens of interest include those derived from the pox family of viruses, including vaccinia virus and avian poxyirus. By way of example, vaccinia virus recombinants expressing the genes can be constructed as follows. The DNA encoding the particular synthetic HIV polypeptide coding sequence is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the coding sequences of interest into the viral genome. The resulting TK recombinant can be selected by culturing the cells in the presence of 5-bromodeoxyuridine and picking viral plaques resistant thereto.

Alternatively, avipoxyiruses, such as the fowlpox and canarypox viruses, can also be used to deliver the genes. Recombinant avipox viruses, expressing immunogens from mammalian pathogens, are known to confer protective immunity when administered to non-avian species. The use of an avipox vector is particularly desirable in human and other mammalian species since members of the avipox genus can only productively replicate in susceptible avian species and therefore are not infective in mammalian cells. Methods for producing recombinant avipoxyiruses are known in the art and employ genetic recombination, as described above with respect to the production of vaccinia viruses. See, e.g., WO 91/12882; WO 89/03429; and WO 92/03545.

Molecular conjugate vectors, such as the adenovirus chimeric vectors described in Michael et al., *J. Biol. Chem.* (1993) 268:6866–6869 and Wagner et al., *Proc. Natl. Acad. Sci. USA* (1992) 89:6099–6103, can also be used for gene delivery.

Members of the Alphavirus genus, such as, but not limited to, vectors derived from the Sindbis, Semliki Forest, and Venezuelan Equine Encephalitis viruses, will also find use as viral vectors for delivering the polynucleotides of the present invention (for example, a synthetic Gag-polypeptide encoding expression cassette). For a description of Sindbis-virus derived vectors useful for the practice of the instant methods, see, Dubensky et al., *J. Virol.* (1996) 70:508–519; and International Publication Nos. WO 95/07995 and WO 96/17072; as well as, Dubensky, Jr., T. W., et al., U.S. Pat. No. 5,843,723, issued Dec. 1, 1998, and Dubensky, Jr., T. W., U.S. Pat. No. 5,789,245, issued Aug. 4, 1998, both herein incorporated by reference. Preferred expression systems include, but are not limited to, eucaryotic layered vector initiation systems (e.g., U.S. Pat. No. 6,015,686, U.S. Pat. No. 5, 814,482, U.S. Pat. No. 6,015,694, U.S. Pat. No. 5,789,245, EP 1029068A2, WO 9918226A2/A3, EP 00907746A2, WO 9738087A2, all herein incorporated by reference in their entireties).

A vaccinia based infection/transfection system can be conveniently used to provide for inducible, transient expression of the coding sequences of interest in a host cell. In this system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the polynucleotide of interest, driven by a T7 promoter. The polymerase expressed in the cytoplasm from the vaccinia virus recombinant transcribes the transfected DNA into RNA which is then translated into protein by the host translational machinery. The method provides for high level, transient, cytoplasmic production of large quantities of RNA and its translation products. See, e.g., Elroy-Stein and Moss, *Proc. Natl. Acad. Sci. USA* (1990) 87:6743–6747; Fuerst et al., *Proc. Natl. Acad. Sci. USA* (1986) 83:8122–8126.

As an alternative approach to infection with vaccinia or avipox virus recombinants, or to the delivery of genes using other viral vectors, an amplification system can be used that will lead to high level expression following introduction into host cells. Specifically, a T7 RNA polymerase promoter preceding the coding region for T7 RNA polymerase can be engineered. Translation of RNA derived from this template will generate T7 RNA polymerase which in turn will transcribe more template. Concomitantly, there will be a cDNA whose expression is under the control of the T7 promoter. Thus, some of the T7 RNA polymerase generated from translation of the amplification template RNA will lead to transcription of the desired gene. Because some T7 RNA polymerase is required to initiate the amplification, T7 RNA polymerase can be introduced into cells along with the template(s) to prime the transcription reaction. The polymerase can be introduced as a protein or on a plasmid encoding the RNA polymerase. For a further discussion of T7 systems and their use for transforming cells, see, e.g., International Publication No. WO 94/26911; Studier and Moffatt, *J. Mol. Biol.* (1986) 189:113–130; Deng and Wolff, Gene (1994) 143:245–249; Gao et al., *Biochem. Biophys. Res. Commun.* (1994) 200:1201–1206; Gao and Huang, *Nuc. Acids Res.* (1993) 21:2867–2872; Chen et al., *Nuc. Acids Res.* (1994) 22:2114–2120; and U.S. Pat. No. 5,135,855.

Delivery of the expression cassettes of the present invention can also be accomplished using eucaryotic expression vectors comprising CMV-derived elements, such vectors include, but are not limited to, the following: pCMVKm2, pCMV-iink pCMVPLEdhfr, and pCMV6a (all described above).

Synthetic expression cassettes of interest can also be delivered without a viral vector. For example, the synthetic expression cassette can be packaged in liposomes prior to delivery to the subject or to cells derived therefrom. Lipid encapsulation is generally accomplished using liposomes which are able to stably bind or entrap and retain nucleic acid. The ratio of condensed DNA to lipid preparation can vary but will generally be around 1:1 (mg DNA:micromoles lipid), or more of lipid. For a review of the use of liposomes as carriers for delivery of nucleic acids, see, Hug and Sleight, *Biochim. Biophys. Acta.* (1991) 1097:1–17; Straubinger et al., in *Methods of Enzymology* (1983), Vol. 101, pp. 512–527.

Liposomal preparations for use in the present invention include cationic (positively charged), anionic (negatively charged) and neutral preparations, with cationic liposomes particularly preferred. Cationic liposomes have been shown to mediate intracellular delivery of plasmid DNA (Felgner et al., *Proc. Natl. Acad. Sci. USA* (1987) 84:7413–7416); mRNA (Malone et al., *Proc. Natl. Acad. Sci. USA* (1989) 86:6077–6081); and purified transcription factors (Debs et al., *J. Biol. Chem.* (1990) 265:10189–10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner et al., *Proc. Natl. Acad. Sci. USA* (1987) 84:7413–7416). Other commercially available lipids include (DDAB/DOPE) and DOTAP/DOPE (Boerhinger). Other cationic liposomes can be prepared from readily available materials using techniques well known in the art. See, e.g., Szoka et al., *Proc. Natl. Acad. Sci. USA* (1978) 75:4194–4198; PCT Publication No. WO 90/11092 for a description of the synthesis of DOTAP (1,2-bis(oleoyloxy)-3-(trimethylammonio)propane) liposomes.

Similarly, anionic and neutral liposomes are readily available, such as, from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See, e.g., Straubinger et al., in METHODS OF IMMUNOLOGY (1983), Vol. 101, pp. 512–527; Szoka et al., *Proc. Natl. Acad. Sci. USA* (1978) 75:4194–4198; Papahadjopoulos et al., *Biochim. Biophys. Acta* (1975) 394:483; Wilson et al., *Cell* (1979) 17:77); Deamer and Bangham, *Biochim. Biophys. Acta* (1976) 443:629; Ostro et al., *Biochem. Biophys. Res. Commun.* (1977) 76:836; Fraley et al., *Proc. Natl. Acad. Sci. USA* (1979) 76:3348); Enoch and Strittmatter, *Proc. Natl. Acad. Sci. USA* (1979) 76:145); Fraley et al., *J. Biol. Chem.* (1980) 255:10431; Szoka and Papahadjopoulos, *Proc. Natl. Acad. Sci. USA* (1978) 75:145; and Schaefer-Ridder et al., *Science* (1982) 215:166.

The DNA and/or protein antigen(s) can also be delivered in cochleate lipid compositions similar to those described by Papahadjopoulos et al., *Biochem. Biophys. Acta.* (1975) 394:483–491. See, also, U.S. Pat. Nos. 4,663,161 and 4,871,488.

The synthetic expression cassette of interest may also be encapsulated, adsorbed to, or associated with, particulate carriers. Such carriers present multiple copies of a selected antigen to the immune system and promote trapping and retention of antigens in local lymph nodes. The particles can be phagocytosed by macrophages and can enhance antigen presentation through cytokine release. Examples of particulate carriers include those derived from polymethyl methacrylate polymers, as well as microparticles derived from poly(lactides) and poly(lactide-co-glycolides), known as PLG. See, e.g., Jeffery et al., *Pharm. Res.* (1993) 10:362–368; McGee J P, et al., *J Microencapsul.* 14(2): 197–210, 1997; O'Hagan DT, et al., *Vaccine* 11(2):149–54, 1993. Suitable microparticles may also be manufactured in the presence of charged detergents, such as anionic or cationic detergents, to yield microparticles with a surface having a net negative or a net positive charge. For example, microparticles manufactured with anionic detergents, such as hexadecyltrimethylammonium bromide (CTAB), i.e. CTAB-PLG microparticles, adsorb negatively charged macromolecules, such as DNA. (see, e.g., Int'l Application Number PCT/US99/17308).

Furthermore, other particulate systems and polymers can be used for the in vivo or ex vivo delivery of the gene of interest. For example, polymers such as polylysine, polyarginine, polyornithine, spermine, spermidine, as well as conjugates of these molecules, are useful for transferring a nucleic acid of interest. Similarly, DEAE dextran-mediated transfection, calcium phosphate precipitation or precipitation using other insoluble inorganic salts, such as strontium phosphate, aluminum silicates including bentonite and kaolin, chromic oxide, magnesium silicate, talc, and the like, will find use with the present methods. See, e.g., Felgner, P. L., *Advanced Drug Delivery Reviews* (1990) 5:163–187, for a review of delivery systems useful for gene transfer. Peptoids (Zuckerman, R. N., et al., U.S. Pat. No. 5,831,005, issued Nov. 3, 1998, herein incorporated by reference) may also be used for delivery of a construct of the present invention.

Additionally, biolistic delivery systems employing particulate carriers such as gold and tungsten, are especially useful for delivering synthetic expression cassettes of the present invention. The particles are coated with the synthetic expression cassette(s) to be delivered and accelerated to high velocity, generally under a reduced atmosphere, using a gun powder discharge from a "gene gun." For a description of such techniques, and apparatuses useful therefore, see, e.g., U.S. Pat. Nos. 4,945,050; 5,036,006; 5,100,792; 5,179,022; 5,371,015; and 5,478,744. Also, needle-less injection systems can be used (Davis, H. L., et al, *Vaccine* 12:1503–1509, 1994; Bioject, Inc., Portland, Oreg.).

Recombinant vectors carrying a synthetic expression cassette of the present invention are formulated into compositions for delivery to the vertebrate subject. These compositions may either be prophylactic (to prevent infection) or therapeutic (to treat disease after infection). The compositions will comprise a "therapeutically effective amount" of the gene of interest such that an amount of the antigen can be produced in vivo so that an immune response is generated in the individual to which it is administered. The exact amount necessary will vary depending on the subject being treated; the age and general condition of the subject to be treated; the capacity of the subject's immune system to synthesize antibodies; the degree of protection desired; the severity of the condition being treated; the particular antigen selected and its mode of administration, among other factors. An appropriate effective amount can be readily determined by one of skill in the art. Thus, a "therapeutically effective amount" will fall in a relatively broad range that can be determined through routine trials.

The compositions will generally include one or more "pharmaceutically acceptable excipients or vehicles" such as water, saline, glycerol, polyethyleneglycol, hyaluronic acid, ethanol, etc. Additionally, auxiliary substances, such as wetting or emulsifying agents, pH buffering substances, and the like, may be present in such vehicles. Certain facilitators of nucleic acid uptake and/or expression can also be included in the compositions or coadministered, such as, but not limited to, bupivacaine, cardiotoxin and sucrose.

Once formulated, the compositions of the invention can be administered directly to the subject (e.g., as described above) or, alternatively, delivered ex vivo, to cells derived from the subject, using methods such as those described above. For example, methods for the ex vivo delivery and reimplantation of transformed cells into a subject are known in the art and can include, e.g., dextran-mediated transfection, calcium phosphate precipitation, polybrene mediated transfection, lipofectamine and LT-1 mediated transfection, protoplast fusion, electroporation, encapsulation of the polynucleotide(s) (with or without the corresponding antigen) in liposomes, and direct microinjection of the DNA into nuclei.

Direct delivery of synthetic expression cassette compositions in vivo will generally be accomplished with or without viral vectors, as described above, by injection using either a conventional syringe or a gene gun, such as the Accell® gene delivery system (PowderJect Technologies, Inc., Oxford, England). The constructs can be injected either subcutaneously, epidermally, intradermally, intramucosally such as nasally, rectally and vaginally, intraperitoneally, intravenously, orally or intramuscularly. Delivery of DNA into cells of the epidermis is particularly preferred as this mode of administration provides access to skin-associated lymphoid cells and provides for a transient presence of DNA in the recipient. Other modes of administration include oral and pulmonary administration, suppositories, needle-less injection, transcutaneous and transdermal applications. Dosage treatment may be a single dose schedule or a multiple dose schedule. Administration of nucleic acids may also be combined with administration of peptides or other substances.

Exemplary immunogenicity studies are presented in Examples 4, 5, 6, 9, 10, 11, and 12.

2.4.2 Ex vivo Delivery of the Synthetic Expression Cassettes of the Present Invention In one embodiment, T cells, and related cell types (including but not limited to antigen presenting cells, such as, macrophage, monocytes, lymphoid cells, dendritic cells, B-cells, T-cells, stem cells, and progenitor cells thereof), can be used for ex vivo delivery of the synthetic expression cassettes of the present invention. T cells can be isolated from peripheral blood lymphocytes (PBLs) by a variety of procedures known to those skilled in the art. For example, T cell populations can be "enriched" from a population of PBLs through the removal of accessory and B cells. In particular, T cell enrichment can be accomplished by the elimination of non-T cells using anti-MHC class II monoclonal antibodies. Similarly, other antibodies can be used to deplete specific populations of non-T cells. For example, anti-Ig antibody molecules can be used to deplete B cells and anti-MacI antibody molecules can be used to deplete macrophages.

T cells can be further fractionated into a number of different subpopulations by techniques known to those skilled in the art. Two major subpopulations can be isolated based on their differential expression of the cell surface markers CD4 and CD8. For example, following the enrichment of T cells as described above, CD4$^+$ cells can be enriched using antibodies specific for CD4 (see Coligan et al., supra). The antibodies may be coupled to a solid support such as magnetic beads. Conversely, CD8+ cells can be enriched through the use of antibodies specific for CD4 (to remove CD4$^+$ cells), or can be isolated by the use of CD8 antibodies coupled to a solid support. CD4 lymphocytes from HIV-1 infected patients can be expanded ex vivo, before or after transduction as described by Wilson et. al. (1995) *J. Infect. Dis.* 172:88.

Following purification of T cells, a variety of methods of genetic modification known to those skilled in the art can be performed using non-viral or viral-based gene transfer vectors constructed as described herein. For example, one such approach involves transduction of the purified T cell population with vector-containing supernatant of cultures derived from vector producing cells. A second approach involves co-cultivation of an irradiated monolayer of vector-producing cells with the purified T cells. A third approach involves a similar co-cultivation approach; however, the purified T cells are pre-stimulated with various cytokines and cultured 48 hours prior to the co-cultivation with the irradiated vector producing cells. Pre-stimulation prior to such transduction increases effective gene transfer (Nolta et al. (1992) *Exp. Hematol.* 20:1065). Stimulation of these cultures to proliferate also provides increased cell populations for re-infusion into the patient. Subsequent to co-cultivation, T cells are collected from the vector producing cell monolayer, expanded, and frozen in liquid nitrogen.

Gene transfer vectors, containing one or more synthetic expression cassette of the present invention (associated with appropriate control elements for delivery to the isolated T cells) can be assembled using known methods and following the guidance of the present specification.

Selectable markers can also be used in the construction of gene transfer vectors. For example, a marker can be used which imparts to a mammalian cell transduced with the gene transfer vector resistance to a cytotoxic agent. The cytotoxic agent can be, but is not limited to, neomycin, aminoglycoside, tetracycline, chloramphenicol, sulfonamide, actinomycin, netropsin, distamycin A, anthracychne, or pyrazinamide. For example, neomycin phosphotransferase II imparts resistance to the neomycin analogue geneticin (G418).

The T cells can also be maintained in a medium containing at least one type of growth factor prior to being selected. A variety of growth factors are known in the art which sustain the growth of a particular cell type. Examples of such growth factors are cytokine mitogens such as rIL-2, IL-10, IL-12, and IL-15, which promote growth and activation of lymphocytes. Certain types of cells are stimulated by other growth factors such as hormones, including human chorionic gonadotropin (hCG) and human growth hormone. The selection of an appropriate growth factor for a particular cell population is readily accomplished by one of skill in the art.

For example, white blood cells such as differentiated progenitor and stem cells are stimulated by a variety of growth factors. More particularly, IL-3, IL-4, IL-5, IL-6, IL-9, GM-CSF, M-CSF, and G-CSF, produced by activated $T_H$ and activated macrophages, stimulate myeloid stem cells, which then differentiate into pluripotent stem cells, granulocyte-monocyte progenitors, eosinophil progenitors, basophil progenitors, megakaryocytes, and erythroid progenitors. Differentiation is modulated by growth factors such as GM-CSF, IL-3, IL-6, IL-11, and EPO.

Pluripotent stem cells then differentiate into lymphoid stem cells, bone marrow stromal cells, T cell progenitors, B cell progenitors, thymocytes, $T_H$ Cells, $T_C$ cells, and B cells. This differentiation is modulated by growth factors such as IL-3, IL-4, IL-6, IL-7, GM-CSF, M-CSF, G-CSF, IL-2, and IL-5.

Granulocyte-monocyte progenitors differentiate to monocytes, macrophages, and neutrophils. Such differentiation is modulated by the growth factors GM-CSF, M-CSF, and IL-8. Eosinophil progenitors differentiate into eosinophils. This process is modulated by GM-CSF and IL-5.

The differentiation of basophil progenitors into mast cells and basophils is modulated by GM-CSF, IL-4, and IL-9. Megakaryocytes produce platelets in response to GM-CSF, EPO, and IL-6. Erythroid progenitor cells differentiate into red blood cells in response to EPO.

Thus, during activation by the CD3-binding agent, T cells can also be contacted with a mitogen, for example a cytokine such as IL-2. In particularly preferred embodiments, the IL-2 is added to the population of T cells at a concentration of about 50 to 100 µg/ml. Activation with the CD3-binding agent can be carried out for 2 to 4 days.

Once suitably activated, the T cells are genetically modified by contacting the same with a suitable gene transfer vector under conditions that allow for transfection of the vectors into the T cells. Genetic modification is carried out when the cell density of the T cell population is between about $0.1 \times 10^6$ and $5 \times 10^6$, preferably between about $0.5 \times 10^6$ and $2 \times 10^6$. A number of suitable viral and nonviral-based gene transfer vectors have been described for use herein.

After transduction, transduced cells are selected away from non-transduced cells using known techniques. For example, if the gene transfer vector used in the transduction includes a selectable marker which confers resistance to a cytotoxic agent, the cells can be contacted with the appropriate cytotoxic agent, whereby non-transduced cells can be negatively selected away from the transduced cells. If the selectable marker is a cell surface marker, the cells can be contacted with a binding agent specific for the particular cell surface marker, whereby the transduced cells can be positively selected away from the population. The selection step can also entail fluorescence-activated cell sorting (FACS) techniques, such as where FACS is used to select cells from the population containing a particular surface marker, or the selection step can entail the use of magnetically responsive particles as retrievable supports for target cell capture and/or background removal.

More particularly, positive selection of the transduced cells can be performed using a FACS cell sorter (e.g. a FACSVantage™ Cell Sorter, Becton Dickinson Immunocytometry Systems, San Jose, Calif.) to sort and collect transduced cells expressing a selectable cell surface marker. Following transduction, the cells are stained with fluorescent-labeled antibody molecules directed against the particular cell surface marker. The amount of bound antibody on each cell can be measured by passing droplets containing the cells through the cell sorter. By imparting an electromagnetic charge to droplets containing the stained cells, the transduced cells can be separated from other cells. The positively selected cells are then harvested in sterile collection vessels. These cell sorting procedures are described in detail, for example, in the FACSVantage™ Training Manual, with particular reference to sections 3–11 to 3–28 and 10–1 to 10–17.

Positive selection of the transduced cells can also be performed using magnetic separation of cells based on expression or a particular cell surface marker. In such separation techniques, cells to be positively selected are first contacted with specific binding agent (e.g., an antibody or reagent the interacts specifically with the cell surface marker). The cells are then contacted with retrievable particles (e.g., magnetically responsive particles) which are coupled with a reagent that binds the specific binding agent (that has bound to the positive cells). The cell-binding agent-particle complex can then be physically separated from non-labeled cells, for example using a magnetic field. When using magnetically responsive particles, the labeled cells can be retained in a container using a magnetic filed while the negative cells are removed. These and similar separation procedures are known to those of ordinary skill in the art.

Expression of the vector in the selected transduced cells can be assessed by a number of assays known to those skilled in the art. For example, Western blot or Northern analysis can be employed depending on the nature of the inserted nucleotide sequence of interest. Once expression has been established and the transformed T cells have been tested for the presence of the selected synthetic expression cassette, they are ready for infusion into a patient via the peripheral blood stream.

The invention includes a kit for genetic modification of an ex vivo population of primary mammalian cells. The kit typically contains a gene transfer vector coding for at least one selectable marker and at least one synthetic expression cassette contained in one or more containers, ancillary reagents or hardware, and instructions for use of the kit.

2.4.3 Further Delivery Regimes

Any of the polynucleotides (e.g., expression cassettes) or polypeptides described herein (delivered by any of the methods described above) can also be used in combination with other DNA delivery systems and/or protein delivery systems. Non-limiting examples include co-administration of these molecules, for example, in prime-boost methods where one or more molecules are delivered in a "priming" step and, subsequently, one or more molecules are delivered in a "boosting" step. In certain embodiments, the delivery of one or more nucleic acid-containing compositions and is followed by delivery of one or more nucleic acid-containing compositions and/or one or more polypeptide-containing compositions (e.g., polypeptides comprising HIV antigens). In other embodiments, multiple nucleic acid "primes" (of the same or different nucleic acid molecules) can be followed by multiple polypeptide "boosts" (of the same or different polypeptides). Other examples include multiple nucleic acid administrations and multiple polypeptide administrations.

In any method involving co-administration, the various compositions can be delivered in any order. Thus, in embodiments including delivery of multiple different compositions or molecules, the nucleic acids need not be all delivered before the polypeptides. For example, the priming step may include delivery of one or more polypeptides and the boosting comprises delivery of one or more nucleic acids and/or one more polypeptides. Multiple polypeptide administrations can be followed by multiple nucleic acid administrations or polypeptide and nucleic acid administrations can be performed in any order. In any of the embodiments described herein, the nucleic acid molecules can encode all, some or none of the polypeptides. Thus, one or more or the nucleic acid molecules (e.g., expression cassettes) described herein and/or one or more of the polypeptides described herein can be co-administered in any order and via any administration routes. Therefore, any combination of polynucleotides and/or polypeptides described herein can be used to generate elicit an immune reaction.

3.0 Improved HIV-1 Gag and Pol Expression Cassettes

While not desiring to be bound by any particular model, theory, or hypothesis, the following information is presented to provide a more complete understanding of the present invention.

The world health organization (WHO) estimated the number of people worldwide that are infected with HIV-1 to exceed 36.1 million. The development of a safe and effective HIV vaccine is therefore essential at this time. Recent studies have demonstrated the importance of CTL in controlling the HIV-1 replication in infected patients. Furthermore, CTL reactivity with multiple HIV antigens will be necessary for the effective control of virus replication. Experiments performed in support of the present invention suggest that the inclusion of HIV-1 Gag and Pol, beside Env for the induction of neutralizing antibodies, into the vaccine is useful.

To increase the potency of HIV-1 vaccine candidates, codon modified Gag and Pol expression cassettes were designed, either for Gag alone or Gag plus Pol. To evaluate possible differences in expression and potency, the expression of these constructs was analyzed and immunogenicity studies carried out in mice.

Several expression cassettes encoding Gag and Pol were designed, including, but not limited to, the following: Gag-Protease, GagPolΔintegrase with frameshift (gagFSpol), and GagPolΔintegrase in-frame (gagpol). Versions of GagPolΔintegrase in-frame were also designed with attenuated (Att) or non-functional Protease (Ina). The nucleic acid sequences were codon modified to correspond to the codon usage of highly expressed human genes. Mice were immunized with titrated DNA doses and humoral and cellular immune responses evaluated by ELISA and intracellular cytokine staining (Example 10).

The immune responses in mice has been seen to be correlated with relative levels of expression in vitro. Vaccine studies in rhesus monkeys will further address immune responses and expression levels in vivo.

4.0 Enhanced Vaccine Technologies for the Induction of Potent Neutralizing Antibodies and Cellular Immune Responses Against HIV.

While not desiring to be bound by any particular model, theory, or hypothesis, the following information is presented to provide a more complete understanding of the present invention.

Protection against HIV infection will likely require potent and broadly reactive pre-existing neutralizing antibodies in vaccinated individuals exposed to a virus challenge. Although cellular immune responses are desirable to control viremia in those who get infected, protection against infection has not been demonstrated for vaccine approaches that rely exclusively on the induction of these responses. For this reason, experiments performed in support of the present invention use prime-boost approaches that employ novel V-deleted envelope antigens from primary HIV isolates (e.g., R5 subtype B (HIV-1$_{SF162}$) and subtype C (HIV-1$_{TV1}$) strains). These antigens were delivered by enhanced DNA [polyactide co-glycolide (PLG) microparticle formulations or electroporation] or alphavirus replicon particle-based vaccine approaches, followed by booster immunizations with Env proteins in MF59 adjuvant. Efficient in vivo expression of plasmid encoded genes by electrical permeabilization has been described (see, e.g., Zucchelli et al. (2000) *J. Virol.* 74:11598–11607; Banga et al. (1998) *Trends Biotechnol.* 10:408–412; Heller et al. (1996) *Febs Lett.* 389:225–228; Mathiesen et al. (1999) *Gene Ther.* 4:508–514; Mir et al. (1999) *Proc. Nat'l Acad. Sci. USA* 8:4262–4267; Nishi et al. (1996) *Cancer Res.* 5:1050–1055). Both native and V-deleted monomeric (gp120) and oligomeric (o-gp140) forms of protein from the SF162 strain were tested as boosters. All protein preparations were highly purified and extensively characterized by biophysical and immunochemical methodologies. Results from rabbit and primate immunogenicity studies indicated that, whereas neutralizing antibody responses could be consistently induced against the parental non-V2-deleted SF162 virus, the induction of responses against heterologous HIV strains improved with deletion of the V2 loop of the immunogens. Moreover, using these prime-boost vaccine regimens, potent HIV antigen-specific CD4+ and CD8+ T-cell responses were also demonstrated.

Based on these findings, V2-deleted envelope DNA and protein vaccines were chosen for advancement toward clinical evaluation. Similar approaches for immunization may be employed using, for example, nucleic acid immunization employing the synthetic HIV polynucleotides of the present invention coupled with corresponding or heterologous HIV-derived polypeptide boosts.

One embodiment of this aspect of the present invention may be described generally as follows. Antigens are selected for the vaccine composition(s). Env polypeptides are typically employed in a first antigenic composition used to induce an immune response. Further, Gag polypeptides are typically employed in a second antigenic composition used to induce an immune response. The second antigenic composition may include further HIV-derived polypeptide sequences, including, but not limited to, Pol, Tat, Rev, Nef, Vif, Vpr, and/or Vpu sequences. A DNA prime vaccination is typically performed with the first and second antigenic compositions. Further DNA vaccinations with one or more of the antigenic compositions may also be included at selected time intervals. The prime is typically followed by at least one boost. The boost may, for example, include adjuvanted HIV-derived polypeptides (e.g., corresponding to those used for the DNA vaccinations), coding sequences for HIV-derived polypeptides (e.g., corresponding to those used for the DNA vaccinations) encoded by a viral vector, further DNA vaccinations, and/or combinations of the foregoing. In one embodiment, a DNA prime is administered with a first antigenic composition (e.g., a DNA construct encoding an Envelope polypeptide) and second antigenic composition (e.g., a DNA construct encoding a Gag polypeptide, a Pol polypeptide, a Tat polypeptide, a Nef polypeptide, and a Rev polypeptide). The DNA construct for use in the prime may, for example, comprise a CMV promoter operably linked to the polynucleotide encoding the polypeptide sequence. The DNA prime is followed by a boost, for example, an adjuvanted Envelope polypeptide boost and a viral vector boost (where the viral vector encodes, e.g., a Gag polypeptide, a Pol polypeptide, a Tat polypeptide, a Nef polypeptide, and a Rev polypeptide). Alternately (or in addition), the boost may be an adjuvanted Gag polypeptide, Pol polypeptide, Tat polypeptide, Nef polypeptide, and Rev polypeptide boost and a viral vector boost (where the viral vector encodes, e.g., an Envelope polypeptide). The boost may include all polypeptide antigens which were encoded in the DNA prime; however, this is not required. Further, different polypeptide antigens may be used in the boost relative to the initial vaccination and visa versa. Further, the initial vaccination may be a viral vector rather than a DNA construct.

Some factors that may be considered in HIV envelope vaccine design are as follows. Envelope-based vaccines have demonstrated protection against infection in non-human primate models. Passive antibody studies have demonstrated protection against HIV infection in the presence of neutralizing antibodies against the virus challenge stock. Vaccines that exclude Env generally confer less protective efficacy. Experiments performed in support of the present invention have demonstrated that monomeric gp120 protein-derived from the SF2 lab strain provided neutralization of HIV-1 lab strains and protection against virus challenges in primate models. Primary gp120 protein derived from Thai E field strains provided cross-subtype neutralization of lab strains. Primary sub-type B oligomeric o-gp140 protein provided partial neutralization of subtype B primary (field) isolates. Primary sub-type B o-gp140ΔV2 DNA prime plus protein boost provided potent neutralization of diverse sub-type B primary isolates and protection against virus challenge in primate models. Primary sub-type C o-gp140 and o-gp140ΔV2 likely provide similar results to those just described for sub-type B.

Vaccine strategies for induction of potent, broadly reactive, neutralizing antibodies may be assisted by construction of Envelope polypeptide structures that expose conserved neutralizing epitopes, for example, variable-region deletions and de-glycosylations, envelope protein-receptor complexes, rational design based on crystal structure (e.g., β-sheet deletions), and gp41-fusion domain based immunogens.

Stable CHO cell lines for envelope protein production have been developed using optimized envelope polypeptide coding sequences, including, but not limited to, the following: gp120, o-gp140, gp120ΔV2, o-gp140ΔV2, gp120ΔV1V2, o-gp140ΔV1V2.

In addition, following prime-boost regimes (such as those described above) appear to be beneficial to help reduce viral load in infected subjects, as well as possibly slow or prevent progression of HIV-related disease (relative to untreated subjects).

Exemplary antigenic compositions and immunogenicity studies are presented in Examples 9, 10, 11, and 12.

Experimental

Below are examples of specific embodiments for carrying out the present invention. The examples are offered for illustrative purposes only, and are not intended to limit the scope of the present invention in any way.

Efforts have been made to ensure accuracy with respect to numbers used (e.g., amounts, temperatures, etc.), but some experimental error and deviation should, of course, be allowed for.

EXAMPLE 1

Generation of Synthetic Expression Cassettes

A. Generating Synthetic Polynucleotides

The polynucleotide sequences of the present invention were manipulated to maximize expression of their gene products. The order of the following steps may vary.

First, the HIV-1 codon usage pattern was modified so that the resulting nucleic acid coding sequence was comparable to codon usage found in highly expressed human genes. The HIV codon usage reflects a high content of the nucleotides A or T of the codon-triplet. The effect of the HIV-1 codon usage is a high AT content in the DNA sequence that results in a high AU content in the RNA and in a decreased translation ability and instability of the mRNA. In comparison, highly expressed human codons prefer the nucleotides G or C. The wild-type sequences were modified to be comparable to codon usage found in highly expressed human genes.

Second, for some genes non-functional variants were created. In the following table (Table B) mutations affecting the activity of several HIV genes are disclosed. All references cited are herein incorporated by reference.

TABLE B

| Gene | "Region" | Exemplary Mutations |
|------|----------|---------------------|
| Pol | prot | Att = Reduced activity by attenuation of Protease (Thr26Ser) (e.g., Konvalinka et al., 1995, J Virol 69: 7180–86)<br>Ina = Mutated Protease, nonfunctional enzyme (Asp25Ala) (e.g., Konvalinka et al., 1995, J Virol 69: 7180–86) |
| | RT | YM = Deletion of catalytic center (YMDD_AP; SEQ ID NO: 7) (e.g., Biochemistry, 1995, 34, 5351, Patel et al.)<br>WM = Deletion of primer grip region (WMGY_PI; SEQ ID NO: 8)) (e.g., J Biol Chem, 272, 17, 11157, Palaniappan, et al., 1997) |
| | R Nase | no direct mutations, RnaseH is affected by "WM" mutation in RT |
| | Integrase | 1) Mutation of HHCC domain, Cys40Ala (e.g., Wiskerchen et al., 1995, J Virol, 69: 376).<br>2.) Inactivation catalytic center, Asp64Ala, Asp116Ala, Glu 152Ala (e.g., Wiskerchen et al., 1995, J Virol, 69: 376).<br>3) Inactivation of minimal DNA binding domain (MDBD), deletion of Trp235(e.g., Ishikawa et al., 1999, J Virol, 73: 4475).<br>Constructs int.opt.mut.SF2 and int.opt.mut_C (South Africa TV1) both contain all these mutations (1, 2, and 3) |
| Env | | Mutations in cleavage site (e.g., mut1–4, 7)<br>Mutations in glycosylation site (e.g., GM mutants, for example, change Q residue in V1 and/or V2 to N residue; may also be designated by residue altered in sequence) |
| Tat | | Mutants of Tat in transactivation domain (e.g., Caputo et al., 1996, Gene Ther. 3: 235)<br>cys22 mutant (Cys22Gly) = TatC22<br>cys37 mutant (Cys37Ser) = TatC37<br>cys22/37 double mutant = TatC22/37 |
| Rev | | Mutations in Rev domains (e.g., Thomas et al., 1998, J Virol. 72: 2935–44)<br>Mutation in RNA binding-nuclear localization ArgArg38,39AspLeu = M5<br>Mutation in activation domain LeuGlu78,79AspLeu = M10 |
| Nef | | Mutations of myristoylation signal and in oligomerization domain:<br>1. Single point mutation myristoylation signal: Gly-to-Ala = −Myr<br>2. Deletion of N-terminal first 18 (sub-type B, e.g., SF162) or 19 (sub-type C, e.g., South Africa clones) |

TABLE B-continued

| Gene | "Region" | Exemplary Mutations |
|---|---|---|
| | | amino acids: −Myr18 or −Myr19 (respectively) (e.g., Peng and Robert-Guroff, 2001, Immunol Letters 78: 195–200) Single point mutation oligomerization: (e.g., Liu et al., 2000, J Virol 74: 5310–19) Asp125Gly (sub B SF162) or Asp124Gly (sub C South Africa clones) Mutations affecting (1) infectivity (replication) of HIV-virions and/or (2) CD4 down regulation. (e.g., Lundquist et al. (2002) J Virol. 76(9): 4625–33) |
| Vif | | Mutations of Vif: e.g., Simon et al., 1999, J Virol 73: 2675–81 |
| Vpr | | Mutations of Vpr: e.g., Singh et al., 2000, J Virol 74: 10650–57 |
| Vpu | | Mutations of Vpu: e.g., Tiganos et al., 1998, Virology 251: 96–107 |

Constructs comprising some of these mutations are described herein. Vif, vpr and vpu synthetic constructs are described. Reducing or eliminating the function of the associated gene products can be accomplished employing the teachings set forth in the above table, in view of the teachings of the present specification.

In one embodiment of the invention, the full length coding region of the Gag-polymerase sequence is included with the synthetic Gag sequences in order to increase the number of epitopes for virus-like particles expressed by the synthetic, optimized Gag expression cassette. Because synthetic HIV-1 Gag-polymerase expresses the potentially deleterious functional enzymes reverse transcriptase (RT) and integrase (INT) (in addition to the structural proteins and protease), it is important to inactivate RT and INT functions. Several in-frame deletions in the RT and INT reading frame can be made to achieve catalytic nonfunctional enzymes with respect to their RT and INT activity. {Jay. A. Levy (Editor) (1995) *The Retroviridae*, Plenum Press, New York. ISBN 0-306-45033X. Pages 215–20; Grimison, B. and Laurence, J. (1995), *Journal Of Acquired Immune Deficiency Syndromes and Human Retrovirology* 9(1):58–68; Wakefield, J. K.,et al., (1992) *Journal Of Virology* 66(11):6806–6812; Esnouf, R., et al., (1995) *Nature Structural Biology* 2(4): 303–308; Maignan, S., et al., (1998) *Journal Of Molecular Biology* 282(2):359–368; Katz, R. A. and Skalka, A. M. (1994) *Annual Review Of Biochemistry* 73 (1994); Jacobo-Molina, A., et al., (1993) *Proceedings Of the National Academy Of Sciences Of the United States Of America* 90(13):6320–6324; Hickman, A. B., et al., (1994) *Journal Of Biological Chemistry* 269(46):29279–29287; Goldgur, Y., et al., (1998) *Proceedings Of the National Academy Of Sciences Of the United States Of America* 95(16):9150–9154; Goette, M., et al., (1998) *Journal Of Biological Chemistry* 273(17):10139–10146; Gorton, J. L., et al., (1998) *Journal of Virology* 72(6):5046–5055; Engelman, A., et al., (1997) *Journal Of Virology* 71(5):3507–3514; Dyda, F., et al., *Science* 266(5193):1981–1986; Davies, J. F., et al., (1991) *Science* 252(5002):88–95; Bujacz, G., et al., (1996) *Febs Letters* 398(2–3):175–178; Beard, W. A., et al., (1996) *Journal Of Biological Chemistry* 271(21):12213–12220; Kohlstaedt, L. A., et al., (1992) *Science* 256(5065):1783–1790; Krug, M. S. and Berger, S. L. (1991) *Biochemistry* 30(44): 10614–10623; Mazumder, A., et al., (1996) *Molecular Pharmacology* 49(4):621–628; Palaniappan, C., et al., (1997) *Journal Of Biological Chemistry* 272(17):11157–11164; Rodgers, D. W., et al., (1995) *Proceedings Of the National Academy Of Sciences Of the United States Of America* 92(4): 1222–1226; Sheng, N. and Dennis, D. (1993) *Biochemistry* 32(18):4938–4942; Spence, R. A., et al., (1995) *Science* 267(5200):988–993.}

Furthermore selected B- and/or T-cell epitopes can be added to the Gag-polymerase constructs within the deletions of the RT- and INT-coding sequence to replace and augment any epitopes deleted by the functional modifications of RT and INT. Alternately, selected B- and T-cell epitopes (including CTL epitopes) from RT and INT can be included in a minimal VLP formed by expression of the synthetic Gag or synthetic GagProt cassette, described above. (For descriptions of known HIV B- and T-cell epitopes see, HIV Molecular Immunology Database CTL Search Interface; Los Alamos Sequence Compendia, 1987–1997;Internet address: http://hivweb.lanl.gov/immunology/index.html.)

In another aspect, the present invention comprises Env coding sequences that include, but are not limited to, polynucleotide sequences encoding the following HIV-encoded polypeptides: gp160, gp140, and gp120 (see, e.g., U.S. Pat. No. 5,792,459 for a description of the HIV-$1_{SF2}$ ("SF2") Env polypeptide). The relationships between these polypeptides is shown schematically in FIG. 3 (in the figure: the polypeptides are indicated as lines, the amino and carboxy termini are indicated on the gp160 line; the open circle represents the oligomerization domain; the open square represents a transmembrane spanning domain (TM); and "c" represents the location of a cleavage site, in gp140.mut the "X" indicates that the cleavage site has been mutated such that it no longer functions as a cleavage site). The polypeptide gp160 includes the coding sequences for gp120 and gp41. The polypeptide gp41 is comprised of several domains including an oligomerization domain (OD) and a transmembrane spanning domain (TM). In the native envelope, the oligomerization domain is required for the non-covalent association of three gp41 polypeptides to form a trimeric structure: through non-covalent interactions with the gp41 trimer (and itself), the gp120 polypeptides are also organized in a trimeric structure. A cleavage site (or cleavage sites) exists approximately between the polypeptide sequences for gp120 and the polypeptide sequences corresponding to gp41. This cleavage site(s) can be mutated to prevent cleavage at the site. The resulting gp140 polypeptide corresponds to a truncated form of gp160 where the transmembrane spanning domain of gp41 has been deleted. This gp140 polypeptide can exist in both monomeric and oligomeric (i.e. trimeric) forms by virtue of the presence of the oligomerization domain in the gp41 moiety. In the situation where the cleavage site has been mutated to prevent cleavage and the transmembrane portion of gp41 has been deleted the resulting polypeptide product is designated "mutated" gp140 (e.g., gp140.mut). As will be apparent to those in the field, the cleavage site can be mutated in a variety of ways. (See, also, WO 00/39302).

Wild-type HIV coding sequences (e.g., Gag, Env, Pol, tat, rev, nef, vpr, vpu, vif, etc.) can be selected from any known HIV isolate and these sequences manipulated to maximize expression of their gene products following the teachings of the present invention. The wild-type coding region maybe modified in one or more of the following ways. In one embodiment, sequences encoding hypervariable regions of Env, particularly V1 and/or V2 were deleted. In other embodiments, mutations were introduced into sequences, for example, encoding the cleavage site in Env to abrogate the enzymatic cleavage of oligomeric gp140 into gp120 monomers. (See, e.g., Earl et al. (1990) *PNAS USA* 87:648–652; Earl et al. (1991) *J. Virol.* 65:31–41). In yet other embodiments, hypervariable region(s) were deleted, N-glycosylation sites were removed and/or cleavage sites mutated. As discussed above, different mutations may be introduced into the coding sequences of different genes (see, e.g., Table B). For example, Tat coding sequences were modified according to the teachings of the present specification, for example to affect the transactivation domain of the gene product (e.g., replacing a cystein residue at position 22 with a glycine, Caputo et al. (1996) *Gene Therapy* 3:235).

To create the synthetic coding sequences of the present invention the gene cassettes are designed to comprise the entire coding sequence of interest. Synthetic gene cassettes are constructed by oligonucleotide synthesis and PCR amplification to generate gene fragments. Primers are chosen to provide convenient restriction sites for subcloning. The resulting fragments are then ligated to create the entire desired sequence which is then cloned into an appropriate vector. The final synthetic sequences are (i) screened by restriction endonuclease digestion and analysis,(ii) subjected to DNA sequencing in order to confirm that the desired sequence has been obtained and (iii) the identity and integrity of the expressed protein confirmed by SDS-PAGE and Western blotting. The synthetic coding sequences are assembled at Chiron Corp. (Emeryville, Calif.) or by the Midland Certified Reagent Company (Midland, Tex.).

Percent identity to the synthetic sequences of the present invention can be determined, for example, using the Smith-Waterman search algorithm (Time Logic, Incline Village, Nev.), with the following exemplary parameters: weight matrix=nuc4×4hb; gap opening penalty=20, gap extension penalty=5, reporting threshold=1; alignment threshold=20.

Various forms of the different embodiments of the present invention (e.g., constructs) may be combined.

Exemplary embodiments of the synthetic polynucleotides of the present invention include, but are not limited to, the sequences presented in Table C.

TABLE C

Type C Synthetic, Codon Optimized Polynucleotides

| Name | Figure Number | Description (encoding) |
|---|---|---|
| GagComplPolmut_C (SEQ ID NO: 9) | 6 | Gag complete, Pol, RT mutated; all in-frame |
| GagComplPolmutAtt_C (SEQ ID NO: 10) | 7 | Gag complete, Pol, RT mutated, protease attenuated; all in-frame |
| GagComplPolmutIna_C (SEQ ID NO: 11) | 8 | Gag complete, Pol, RT mutated, protease non-functional; all in-frame |
| GagComplPolmutInaTatRevNef_C (SEQ ID NO: 12) | 9 | Gag complete, Pol, RT mutated, protease non-functional, tat mutated, rev mutated, nef mutated; all in-frame |
| GagPolmut_C (SEQ ID NO: 13) | 10 | Gag, Pol, RT mutated; all in-frame |
| GagPolmutAtt_C (SEQ ID NO: 14) | 11 | Gag, Pol, RT mutated, protease attenuated; all in-frame |
| GagPolmutIna_C (SEQ ID NO: 15) | 12 | Gag, Pol, RT mutated, protease non-functional; all in-frame |
| GagProtInaRTmut_C (SEQ ID NO: 16) | 13 | Gag, protease non-functional, RT mutated; all in-frame |
| GagProtInaRTmutTatRevNef_C (SEQ ID NO: 17) | 14 | Gag, protease non-functional, RT mutated, tat mutated, rev mutated, nef mutated; all in-frame |
| GagRTmut_C (SEQ ID NO: 18) | 15 | Gag, RT mutated; all in-frame |
| GagRTmutTatRevNef_C (SEQ ID NO: 19) | 16 | Gag, RT mutated, tat mutated, rev mutated, nef mutated; all in-frame |
| GagTatRevNef_C (SEQ ID NO: 20) | 17 | Gag, tat mutated, rev mutated, nef mutated; all in-frame |
| gp120mod.TV1.del1 18–210 (SEQ ID NO: 21) | 18 | gp 120 derived from TV1.c8.2, deleted V1/V2 loops and stem |
| gp120mod.TV1.delV1V2 (SEQ ID NO: 22) | 19 | gp120 derived from TV1.c8.2, deleted V1/V2 loops |
| gp120mod.TV1.delV2 (SEQ ID NO: 23) | 20 | gp120 derived from TV1.c8.2, deleted V2 loop |
| gp140mod.TV1.del1 18–210 (SEQ ID NO: 24) | 21 | gp140 derived from TV1.c8.2, deleted V1/V2 loops and stem |
| gp140mod.TV1.delV1V2 (SEQ ID NO: 25) | 22 | gp140 derived from TV1.c8.2, deleted V1/V2 loops |
| gp140mod.TV1.delV2 (SEQ ID NO: 26) | 23 | gp140 derived from TV1.c8.2, deleted V2 loop |
| gp140mod.TV1.mut7 (SEQ ID NO: 27) | 24 | gp140 derived from TV1.c8.2, mutated protease cleavage site |
| gp140mod.TV1.tpa2 (SEQ ID NO: 28) | 25 | gp140 derived from TV1.c8.2, tpa2 leader sequence |
| gp140TMmod.TV1 | 26 | gp140 derived from TV1.c8.2, |

TABLE C-continued Type C Synthetic, Codon Optimized Polynucleotides

| Name | Figure Number | Description (encoding) |
|---|---|---|
| (SEQ ID NO: 29) | | containing the transmembrane region |
| gp160mod.TV1.del1 18–210 (SEQ ID NO: 30) | 27 | gp160 derived from TV1.c8.2, deleted V1/V2 loops and stem |
| gp160mod.TV1.delV1V2 (SEQ ID NO: 31) | 28 | gp160 derived from TV1.c8.2, deleted V1/V2 loops |
| gp160mod.TV1.delV2 (SEQ ID NO: 32) | 29 | gp160 derived from TV1.c8.2, deleted V2 loop |
| gp160mod.TV1.dV1 (SEQ ID NO: 33) | 30 | gp160 derived from TV1.c8.2, deleted V1 loop |
| gp160mod.TV1.dV1-gagmod.BW965 (SEQ ID NO: 34) | 31 | gp160 derived from TV1.c8.2, deleted V1 loop, Gag derived from BW965; all in-frame |
| gp160mod.TV1.dV1V2-gagmod.BW965 (SEQ ID NO: 35) | 32 | gp160 derived from TV1.c8.2, deleted V1/V2 loops, Gag derived from BW965; all in-frame |
| gp160mod.TV1.dV2-gagmod.BW965 (SEQ ID NO: 36) | 33 | gp160 derived from TV1.c8.2, deleted V2 loop, Gag derived from BW965; all in-frame |
| gp160mod.TV1 .tpa2 (SEQ ID NO: 37) | 34 | gp160 derived from TV1.c8.2, tpa2 leader; all in-frame |
| gp160mod.TV1-gagmod.BW965 (SEQ ID NO: 38) | 35 | gp160 derived from TV1.c8.2, Gag derived from BW965; all in-frame |
| int.opt.mut_C (SEQ ID NO: 39) | 36 | integrase mutated |
| int.opt_C (SEQ ID NO: 40) | 37 | integrase |
| nef.D106G.-myr19.opt_C (SEQ ID NO: 41) | 38 | nef mutated |
| p15RnaseH.opt_C (SEQ ID NO: 42) | 39 | p15 RNase H; all in-frame |
| p2Pol.opt.YMWM_C (SEQ ID NO: 43) | 40 | p2 Pol, RT mutated YM WM; all in-frame |
| p2Polopt.YM_C (SEQ ID NO: 44) | 41 | p2 pol, RT mutated YM; all in-frame |
| p2Polopt_C (SEQ ID NO: 45) | 42 | p2 Pol; all in-frame |
| p2PolTatRevNef opt C (SEQ ID NO: 46) | 43 | p2 Pol, RT mutated, protease non-functional, tat mutated, rev mutated, nef mutated; all in-frame |
| p2PolTatRevNef.opt.native_C (SEQ ID NO: 47) | 44 | p2 pol, tat native, rev native, nef native; all in-frame |
| p2PolTatRevNef.opt_C (SEQ ID NO: 48) | 45 | p2 Pol, RT mutated, protease non-functional, tat mutated, rev mutated, nef mutated; all in-frame; all in-frame |
| protInaRT.YM.opt_C (SEQ ID NO: 49) | 46 | Protease non-functional, RT mutated YM; all in-frame |
| protInaRT.YMWM.opt_C (SEQ ID NO: 50) | 47 | Protease non-functional, RT mutated YM WM; all in-frame |
| ProtRT.TatRevNef.opt_C (SEQ ID NO: 51) | 48 | RT mutated, Protease non-functional, tat mutated, rev mutated, nef mutated; all in-frame |
| rev.exon1_2.M5-10.opt_C (SEQ ID NO: 52) | 49 | rev exons 1 and 2 mutated; all in-frame |
| tat.exon1_2.opt.C22-37_C (SEQ ID NO: 53) | 50 | tat exons 1 and 2 mutated; all in-frame |
| tat.exon1_2.opt.C37_C (SEQ ID NO: 54) | 51 | tat exon 1 and 2 mutated; all in-frame |
| TatRevNef.opt.native_ZA (SEQ ID NO: 55) | 52 | tat native, rev native, nef native; all in-frame |
| TatRevNef.opt_ZA (SEQ ID NO: 56) | 53 | tat mutated, rev mutated, nef mutated; all in-frame |
| TatRevNefGag C (SEQ ID NO: 57) | 54 | tat mutated, rev mutated, nef mutated, Gag; all in-frame |
| TatRevNefgagCpolIna C (SEQ ID NO: 58) | 55 | tat mutated, rev mutated, nef mutated, Gag complete, pol, RT mutated, protease non-functional; all in-frame |
| TatRevNefGagProtInaRTmut C (SEQ ID NO: 59) | 56 | tat mutated, rev mutated, nef mutated, Gag, Protease non-functional, RT mutated; all in-frame |

TABLE C-continued

Type C Synthetic, Codon Optimized Polynucleotides

| Name | Figure Number | Description (encoding) |
|---|---|---|
| TatRevNefProtRT opt C (SEQ ID NO: 60) | 57 | tat mutated, rev mutated, nef mutated, protease non-functional, RT mutated; all in-frame |
| gp140modTV1.mut1.dV2 (SEQ ID NO: 183) | 104 | env derived from TV1 mutated in cellular protease cleavage site between gp120/gp41 (may prevent cleavage and may facilitate protein purification) deletion in second variable region (V2) |
| gp140modTV1.mut2.dV2 (SEQ ID NO: 184) | 105 | env derived from TV1 mutated in cellular protease cleavage site between gp120/gp41 (may prevent cleavage and may facilitate protein purification) deletion in second variable region (V2) |
| gp140modTV1.mut3.dV2 (SEQ ID NO: 185) | 106 | env derived from TV1 mutated in cellular protease cleavage site between gp120/gp41 (may prevent cleavage and may facilitate protein purification) deletion in second variable region (V2) |
| gp140modTV1.mut4.dV2 (SEQ ID NO: 186) | 107 | env derived from TV1 mutated in cellular protease cleavage site between gp120/gp41 (may prevent cleavage and may facilitate protein purification) deletion in second variable region (V2) |
| gp140modTV1.GM161 (SEQ ID NO: 187) | 108 | env derived from TV1 glycosylation site mutation (GM) at amino acid position 161 of Env (N to Q substitution) |
| gp140modTV1.GM161-195-204 (SEQ ID NO: 188) | 109 | env derived from TV1 glycosylation site mutation (GM) at amino acid positions 161, 195 and 204 of Env (N to Q substitution) |
| gp140modTV1.GM161-204 (SEQ ID NO: 189) | 110 | env derived from TV1 glycosylation site mutation (GM) at amino acid positions 161 and 204 of Env (N to Q substitution) |
| gp140mod.TV1.GM-V1V2 (SEQ ID NO: 190) | 111 | env derived from TV1 glycosylation site mutation (GM) at various amino acid positions (see also FIG. 114) |
| gp140modC8.2mut7.delV2.Kozmod.Ta (SEQ ID NO: 191) | 112 | env derived from TV1 mutated in cellular protease cleavage site between gp120/gp41 (may prevent cleavage and may facilitate protein purification) deletion in second variable region (V2) 5' Kozak sequence and 3' TAAA termination sequence |
| Nef-myrD124LLAA (SEQ ID NO: 203) | 115 | Nef with mutation in myristoylation site |
| gp160mod.TV2 (SEQ ID NO: 205) | 117 | env derived from TV2 |

B. Creating Expression Cassettes Comprising the Synthetic Polynucleotides of the Present Invention.

The synthetic DNA fragments of the present invention are cloned into the following expression vectors: pCMVKm2, for transient expression assays and DNA immunization studies, the pCMVKm2 vector was derived from pCMV6a (Chapman et al., *Nuc. Acids Res.* (1991) 19:3979–3986) and comprises a kanamycin selectable marker, a ColE1 origin of replication, a CMV promoter enhancer and Intron A, followed by an insertion site for the synthetic sequences described below followed by a polyadenylation signal derived from bovine growth hormone—the pCMVKm2 vector differs from the pCMV-link vector only in that a polylinker site was inserted into pCMVKm2 to generate pCMV-link; pESN2dhfr and pCMVPLEdhfr (also known as pCMVIII), for expression in Chinese Hamster Ovary (CHO)

cells; and, pAcC13, a shuttle vector for use in the Baculovirus expression system (pAcC13, was derived from pAcC12 which was described by Munemitsu S., et al., *Mol Cell Biol.* 10(11):5977–5982, 1990). See, also co-owned WO 00/39303, WO 00/39302, WO 00/39304, WO 02/04493, for a description of these vectors, all herein incorporated by reference in their entireties.

Briefly, construction of pCMVPLEdhfr (pCMVIII) was as follows. To construct a DHFR cassette, the EMCV IRES (internal ribosome entry site) leader was PCR-amplified from pCite-4a+(Novagen, Inc., Milwaukee, Wis.) and inserted into pET-23d (Novagen, Inc., Milwaukee, Wis.) as an Xba-Nco fragment to give pET-EMCV. The dhfr gene was PCR-amplified from pESN2dhfr to give a product with a Gly-Gly-Gly-Ser spacer in place of the translation stop codon and inserted as an Nco-BamHI fragment to give pET-E-DHFR. Next, the attenuated neo gene was PCR amplified from a pSV2Neo (Clontech, Palo Alto, Calif.) derivative and inserted into the unique BamH 1 site of pET-E-DHFR to give pET-E-DHFR/Neo$_{(m2)}$. Then, the bovine growth hormone terminator from pcDNA3 (Invitrogen, Inc., Carlsbad, Calif.) was inserted downstream of the neo gene to give pET-E-DHFR/Neo$_{(m2)}$BGHt. The EMCV-dhfrlneo selectable marker cassette fragment was prepared by cleavage of pET-E-DHFR/Neo$_{(m2)}$BGHt. The CMV enhancer/promoter plus Intron A was transferred from pCMV6a (Chapman et al., *Nuc. Acids Res.* (1991) 19:3979–3986) as a HindIII-Sal1 fragment into pUC19 (New England Biolabs, Inc., Beverly, Mass.). The vector backbone of pUC19 was deleted from the Nde1 to the Sap1 sites. The above described DHFR cassette was added to the construct such that the EMCV IRES followed the CMV promoter to produce the final construct. The vector also contained an ampr gene and an SV40 origin of replication.

Expression vectors of the present invention contain one or more of the synthetic coding sequences disclosed herein, e.g., shown in the Figures. When the expression cassette contains more than one coding sequence the coding sequences may all be in-frame to generate one polyprotein; alternately, the more than one polypeptide coding sequences may comprise a polycistronic message where, for example, an IRES is placed 5' to each polypeptide coding sequence.

EXAMPLE 2

Expression Assays for the Synthetic Coding Sequences

The wild-type sequences are cloned into expression vectors having the same features as the vectors into which the synthetic HIV-derived sequences were cloned.

Expression efficiencies for various vectors carrying the wild-type (any known isolated) and corresponding synthetic sequence(s) are evaluated as follows. Cells from several mammalian cell lines (293, RD, COS-7, and CHO; all obtained from the American Type Culture Collection, 10801 University Boulevard, Manassas, Va. 20110–2209) are transfected with 2 µg of DNA in transfection reagent LT1 (PanVera Corporation, 545 Science Dr., Madison, Wis.). The cells are incubated for 5 hours in reduced serum medium (Opti-MEM, Gibco-BRL, Gaithersburg, Md.). The medium is then replaced with normal medium as follows: 293 cells, IMDM, 10% fetal calf serum, 2% glutamine (BioWhittaker, Walkersville, Md.); RD and COS-7 cells, D-MEM, 10% fetal calf serum, 2% glutamine (Opti-MEM, Gibco-BRL, Gaithersburg, Md.); and CHO cells, Ham's F-12, 10% fetal calf serum, 2% glutamine (Opti-MEM, Gibco-BRL, Gaithersburg, Md.). The cells are incubated for either 48 or 60 hours. Supernatants are harvested and filtered through 0.45 µm syringe filters and, optionally, stored at −20° C.

Supernatants are evaluated using the Coulter p24-assay (Coulter Corporation, Hialeah, Fla., US), using 96-well plates coated with a suitable monoclonal antibody directed against an HIV antigen (e.g., a murine monoclonal directed again an HIV core antigen). The appropriate HIV antigen binds to the coated wells and biotinylated antibodies against HIV recognize the bound antigen. Conjugated strepavidin-horseradish peroxidase reacts with the biotin. Color develops from the reaction of peroxidase with TMB substrate. The reaction is terminated by addition of 4N $H_2SO_4$. The intensity of the color is directly proportional to the amount of HIV antigen in a sample.

Chinese hamster ovary (CHO) cells are also transfected with plasmid DNA encoding the synthetic HIV polypeptides described herein (e.g., pESN2dhfr or pCMVIII vector backbone) using Mirus TransIT-LT 1 polyamine transfection reagent (Pan Vera) according to the manufacturers instructions and incubated for 96 hours. After 96 hours, media is changed to selective media (F12 special with 250 µg/ml G418) and cells are split 1:5 and incubated for an additional 48 hours. Media is changed every 5–7 days until colonies start forming at which time the colonies are picked, plated into 96 well plates and screened by Capture ELISA. Positive clones are expanded in 24 well plates and are screened several times for HIV protein production by Capture ELISA, as described above. After reaching confluency in 24 well plates, positive clones are expanded to T25 flasks (Corning, Corning, N.Y.). These are screened several times after confluency and positive clones are expanded to T75 flasks.

Positive T75 clones are frozen in LN2 and the highest expressing clones are amplified with 0–5 µM methotrexate (MTX) at several concentrations and plated in 100 mm culture dishes. Plates are screened for colony formation and all positive closed are again expanded as described above. Clones are expanded an amplified and screened at each step capture ELISA. Positive clones are frozen at each methotrexate level. Highest producing clones are grown in perfusion bioreactors (3L, 100L) for expansion and adaptation to low serum suspension culture conditions for scale-up to larger bioreactors.

Data from experiments performed in support of the present invention show that the synthetic HIV expression cassettes provided dramatic increases in production of their protein products, relative to the native (wild-type) sequences, when expressed in a variety of cell lines and that stably transfected CHO cell lines, which express the desired HIV polypeptide(s), may be produced. Production of HIV polypeptides using CHO cells provides (i) correct glycosylation patterns and protein conformation (as determined by binding to panel of MAbs); (ii) correct binding to CD4 receptor molecules; (iii) absence of non-mammalian cell contaminants (e.g., insect viruses and/or cells); and (iv) ease of purification.

EXAMPLE 3

Western Blot Analysis of Expression

Western blot analysis of cells transfected with the HIV expression cassettes described herein are performed essentially as described in co-owned WO 00/39302. Briefly, human 293 cells are transfected as described in Example 2 with pCMV6a-based vectors containing native or synthetic HIV expression cassettes. Cells are cultivated for 60 hours post-transfection. Supernatants are prepared as described. Cell lysates are prepared as follows. The cells are washed once with phosphate-buffered saline, lysed with detergent [1% NP40 (Sigma Chemical Co., St. Louis, Mo.) in 0.1 M Tris-HCl, pH 7.5], and the lysate transferred into fresh tubes. SDS-polyacrylamide gels (pre-cast 8–16%; Novex, San Diego, Calif.) are loaded with 20 µl of supernatant or 12.5 µl of cell lysate. A protein standard is also loaded (5 µl, broad size range standard; BioRad Laboratories, Hercules, Calif.). Electrophoresis is carried out and the proteins are transferred using a BioRad Transfer Chamber (BioRad Laboratories, Hercules, Calif.) to Immobilon P membranes (Millipore Corp., Bedford, Mass.) using the transfer buffer recommended by the manufacturer (Millipore), where the transfer is performed at 100 volts for 90 minutes. The membranes are exposed to HIV-1-positive human patient serum and immunostained using o-phenylenediamine dihydrochloride (OPD; Sigma).

The results of the immunoblotting analysis are used to show that cells containing the synthetic HIV expression cassette produce the expected HIV-polypeptide(s) at higher per-cell concentrations than cells containing the native expression cassette.

EXAMPLE 4

In Vivo Immunogenicity of Synthetic HIV Expression Cassettes

A. Immunization

To evaluate the immunogenicity of the synthetic HIV expression cassettes, a mouse study may be performed. The plasmid DNA, e.g., pCMVKM2 carrying an expression cassette comprising a synthetic sequence of the present invention, is diluted to the following final concentrations in a total injection volume of 100 µl: 20 µg, 2 µg, 0.2 µg, and 0.02 µg. To overcome possible negative dilution effects of the diluted DNA, the total DNA concentration in each sample is brought up to 20 µg using the vector (pCMVKM2) alone. As a control, plasmid DNA comprising an expression cassette encoding the native, corresponding polypeptide is handled in the same manner. Twelve groups of four Balb/c mice (Charles River, Boston, Mass.) are intramuscularly immunized (50 µl per leg, intramuscular injection into the tibialis anterior) using varying dosages.

B. Humoral Immune Response

The humoral immune response is checked with a suitable anti-HIV antibody ELISAs (enzyme-linked immunosorbent assays) of the mice sera 0 and 4 weeks post immunization (groups 5–12) and, in addition, 6 and 8 weeks post immunization, respectively, 2 and 4 weeks post second immunization (groups 1–4).

The antibody titers of the sera are determined by anti-HIV antibody ELISA. Briefly, sera from immunized mice were screened for antibodies directed against an appropriate HIV protein (e.g., HIV p55 for Gag). ELISA microtiter plates are coated with 0.2 µg of HIV protein per well overnight and washed four times; subsequently, blocking is done with PBS-0.2% Tween (Sigma) for 2 hours. After removal of the blocking solution, 100 µl of diluted mouse serum is added. Sera are tested at 1/25 dilutions and by serial 3-fold dilutions, thereafter. Microtiter plates are washed four times and incubated with a secondary, peroxidase-coupled anti-mouse IgG antibody (Pierce, Rockford, Ill.). ELISA plates are washed and 100 µl of 3, 3', 5, 5'-tetramethyl benzidine (TMB; Pierce) was added per well. The optical density of each well is measured after 15 minutes. The titers reported are the reciprocal of the dilution of serum that gave a half-maximum optical density (O.D.).

The results of the mouse immunizations with plasmid-DNAs are used to show that the synthetic expression cassettes provide improvement of immunogenicity relative to the native expression cassettes. Also, the second boost immunization induces a secondary immune response after two weeks (groups 1–3).

C. Cellular Immune Response

The frequency of specific cytotoxic T-lymphocytes (CTL) is evaluated by a standard chromium release assay of peptide pulsed Balb/c mouse CD4 cells. HIV protein-expressing vaccinia virus infected CD-8 cells are used as a positive control (vv-protein). Briefly, spleen cells (Effector cells, E) are obtained from the BALB/c mice (immunized as described above). The cells are cultured, restimulated, and assayed for CTL activity against, e.g., Gag peptide-pulsed target cells as described (Doe, B., and Walker, C. M., *AIDS* 10(7):793–794, 1996). Cytotoxic activity is measured in a standard $^{51}$Cr release assay. Target (T) cells are cultured with effector (E) cells at various E:T ratios for 4 hours and the average cpm from duplicate wells is used to calculate percent specific $^{51}$Cr release.

Cytotoxic T-cell (CTL) activity is measured in splenocytes recovered from the mice immunized with HIV DNA constructs described herein. Effector cells from the DNA-immunized animals exhibit specific lysis of HIV peptide-pulsed SV-BALB (MHC matched) targets cells indicative of a CTL response. Target cells that are peptide-pulsed and derived from an MHC-unmatched mouse strain (MC57) are not lysed. The results of the CTL assays are used to show increased potency of synthetic HIV expression cassettes for induction of cytotoxic T-lymphocyte (CTL) responses by DNA immunization.

EXAMPLE 5

In Vivo Immunogenicity of Synthetic HIV Expression Cassettes

A. General Immunization Methods

To evaluate the immunogenicity of the synthetic HIV expression cassettes, studies using guinea pigs, rabbits, mice, rhesus macaques and baboons are performed. The studies are typically structured as follows: DNA immunization alone (single or multiple); DNA immunization followed by protein immunization (boost); DNA immunization followed by Sindbis particle immunization; immunization by Sindbis particles alone.

B. Guinea Pigs

Experiments may be performed using guinea pigs as follows. Groups comprising six guinea pigs each are immunized intramuscularly or mucosally at 0, 4, and 12 weeks with plasmid DNAs encoding expression cassettes comprising one or more the sequences described herein. The animals are subsequently boosted at approximately 18 weeks with a single dose (intramuscular, intradermally or mucosally) of the HIV protein encoded by the sequence(s) of the plasmid boost and/or other HIV proteins. Antibody titers (geometric mean titers) are measured at two weeks following the third DNA immunization and at two weeks after the protein boost. These results are used to demonstrate the usefulness of the synthetic constructs to generate immune responses, as well as, the advantage of providing a protein boost to enhance the immune response following DNA immunization.

C. Rabbits

Experiments may be performed using rabbits as follows. Rabbits are immunized intramuscularly, mucosally, or intradermally (using a Bioject needless syringe) with plasmid DNAs encoding the HIV proteins described herein. The nucleic acid immunizations are followed by protein boosting after the initial immunization. Typically, constructs comprising the synthetic HIV-polypeptide-encoding polynucleotides of the present invention are highly immunogenic and generate substantial antigen binding antibody responses after only 2 immunizations in rabbits.

D. Humoral Immune Response

In any immunized animal model, the humoral immune response is checked in serum specimens from the immunized animals with an anti-HIV antibody ELISAs (enzyme-linked immunosorbent assays) at various times post-immunization. The antibody titers of the sera are determined by anti-HIV antibody ELISA as described above. Briefly, sera from immunized animals are screened for antibodies directed against the HIV polypeptide/protein(s) encoded by the DNA and/or polypeptide used to immunize the animals. Wells of ELISA microtiter plates are coated overnight with the selected HIV polypeptide/protein and washed four times; subsequently, blocking is done with PBS-0.2% Tween (Sigma) for 2 hours. After removal of the blocking solution, 100 µl of diluted mouse serum is added. Sera are tested at 1/25 dilutions and by serial 3-fold dilutions, thereafter. Microtiter plates are washed four times and incubated with a secondary, peroxidase-coupled anti-mouse IgG antibody (Pierce, Rockford, Ill.). ELISA plates are washed and 100 µl of 3, 3', 5, 5'-tetramethyl benzidine (TMB; Pierce) was added per well. The optical density of each well is measured after 15 minutes. Titers are typically reported as the reciprocal of the dilution of serum that gave a half-maximum optical density (O.D.).

Cellular immune response may also be evaluated.

EXAMPLE 6

DNA-Immunization of Baboons and Rhesus Macaques Using Expression Cassettes Comprising the Synthetic HIV Polynucleotides of the Present Invention A. Baboons Four baboons are immunized 3 times (weeks 0, 4 and 8) bilaterally, intramuscular into the quadriceps or mucosally using the gene delivery vehicles described herein. The animals are bled two weeks after each immunization and an HIV antibody ELISA is performed with isolated plasma. The ELISA is performed essentially as described above except the second antibody-conjugate is an anti-human IgG, g-chain specific, peroxidase conjugate (Sigma Chemical Co., St. Louis, Md. 63178) used at a dilution of 1:500. Fifty µg/ml yeast extract may be added to the dilutions of plasma samples and antibody conjugate to reduce non-specific background due to preexisting yeast antibodies in the baboons. Lymphoproliferative responses to are observed in baboons two weeks post-fourth immunization (at week 14), and enhanced substantially post-boosting with HIV-polypeptide (at week 44 and 76). Such proliferation results are indicative of induction of T-helper cell functions.

B. Rhesus Macagues

The improved potency of the synthetic, codon-modified HIV-polypeptide encoding polynucleotides of the present invention, when constructed into expression plasmids may be confirmed in rhesus macaques. Typically, the macaques have detectable HIV-specific CTL after two or three 1 mg doses of modified HIV polynucleotide. In sum, these results demonstrate that the synthetic HIV DNA is immunogenic in non-human primates. Neutralizing antibodies may also detected.

EXAMPLE 7

Co-Transfection of Monocistronic and Multicistronic Constructs

The present invention includes co-transfection with multiple, monocistronic expression cassettes, as well as, co-transfection with one or more multi-cistronic expression cassettes, or combinations thereof.

Such constructs, in a variety of combinations, may be transfected into 293T cells for transient transfection studies.

For example, a bicistronic construct may be made where the coding sequences for the different HIV polypeptides are under the control of a single CMV promoter and, between the two coding sequences, an IRES (internal ribosome entry site (EMCV IRES); Kozak, M., Critical Reviews in Biochemistry and Molecular Biology 27(45):385–402, 1992; Witherell, G. W., et al., Virology 214:660–663, 1995) sequence is introduced after the first HIV coding sequence and before the second HIV coding sequence.

Supernatants collected from cell culture are tested for the presence of the HIV proteins and indicate that appropriate proteins are expressed in the transfected cells (e.g., if an Env coding sequence was present the corresponding Env protein was detected; if a Gag coding sequence was present the corresponding Gag protein was detected, etc).

The production of chimeric VLPs by these cell lines may be determined using electron microscopic analysis. (See, e.g., co-owned WO 00/39302).

EXAMPLE 8

Accessory Gene Components for an HIV-1 Vaccine: Functional Analysis of Mutated Tat, Rev and Nef Type C Antigens The HIV-1 regulatory and accessory genes have received increased attention as components of HIV vaccines due to their role in viral pathogenesis, the high ratio of highly conserved CTL epitopes and their early expression in the viral life cycle. Because of various undesirable properties of these genes, questions regarding their safety and suitability as vaccine components have been raised. Experiments performed in support of the present invention have analyzed candidate HIV-1 subtype C tat, rev, and nef mutants for efficient expression and inactivation of potential deleterious functions. Other HIV subtype accessory genes may be evaluated similarly.

Sequence-modified, mutant tat, rev, and nef genes coding for consensus Tat, Rev and Nef proteins of South African HIV-1 subtype C were constructed using overlapping synthetic oligonucleotides and PCR-based site-directed mutagenesis. Constructs of the wild-type genes of the isolates closely resembling the respective consensus sequences were also made by PCR. In vitro expression of the constructs was analyzed by western blotting. The trans-activation activity of the Tat mutants and nuclear RNA export activity of the Rev mutants were studied after transfection of various cell lines using reporter-gene-based functionality assays.

In vitro expression of all constructs was demonstrated by western blotting using antigen specific mouse serum generated by DNA vaccination of mice with Tat, Rev, or Nef-expression plasmids. Expression levels of the sequence-modified genes were significantly higher than the wild-type genes.

Subtype B and C Tat cDNA was mutated to get TatC22, TatC37, and TatC22/37. Tat activity assays in three cell lines (RD, HeLa and 293). In the background of the subtype C consensus Tat, a single mutation at C22 was insufficient to inactivate LTR-dependent CAT expression. In contrast, this activity was significantly impaired in RD, 293 and HeLa cells using the single mutation, C37, or the double mutation, C22C37 (see Table B). Corresponding results were obtained for Tat mutants derived from subtype B strains.

Exemplary results are presented in FIG. 4 for transactivation activity of Tat mutants on LTR-CAT plasmid in 293 cells. Three independent assays were performed for each construct (FIG. 4, legend (1), (2), (3)).

The subtype C constructs TatC22ProtRTTatRevNef and ProtRTTatC22RevNef showed reduced Tat activity when compared to TatC22 alone, probably due to structural changes caused by the fusion protein.

For Rev constructs, to test for the loss of function, a CAT assay with a reporter plasmid including native or mutated Rev was used. As shown in FIG. 5, compared to wild-type Rev, the mRNA export function of the subtype C Rev with a double mutation, M5M10 (see Table B), was significantly lower. The background levels are shown in the "mock" data and the pDM128 reporter plasmid without Rev data. Two independent assays were performed for each construct (FIG. 5, legend (1), (2)).

Assays to measure Nef-specific functions may also be performed (Nef mutations are described in Table B). For example, FACs analysis is used to look for the presence of MHC 1 and CD4 on cell surfaces. Cells are assayed in the presence and absence of Nef expression (for controls), as well as using the synthetic polynucleotides of the present invention that encode native nef protein and mutated nef protein. Down-regulation of MHC1 and CD4 expression indicates that the nef gene product is not functional, i.e., if nef is non-functional there is no down regulation.

These data demonstrate the impaired functionality of tat and rev DNA immunogens that may form part of a multi-component HIV-1 subtype C vaccine. In contrast to previous published data by other groups, the C22 mutation did not sufficiently inactivate the transactivation function of Tat. The C37 mutation appeared to be required for inactivation of subtype C and subtype B Tat proteins.

EXAMPLE 9

Evaluation of Immunogenicity of Various HIV Polypeptide Encoding Plasmids

As noted above, the immunogenicity of any of the polynucleotides or expression cassettes described herein is readily evaluated. In the following table (Table D) are exemplified procedures involving a comparison of the immunogenicity of subtype B and C envelope plasmids, both individually and as a mixed-subtype vaccine, using electroporation, in rabbits. It will be apparent that such methods are equally applicable to any other HIV polypeptide.

TABLE D

| Grp | Animal | Imm'n # | Adjuvant | Immunogen | Total Dose | Vol/ Site | Sites/ Animal | Route |
|---|---|---|---|---|---|---|---|---|
| 1 | 1–4 | 1, 2 | — | pCMV 160 TV1 DNA | 1.0 mg | 0.5 ml | 2 | IM/Quad (Electro) |
| | | 3 | — | pCMV 160 TV1 DNA | 1.0 mg | 0.5 ml | 2 | IM/Quad (Electro) |
| | | | MF59C | Protein TBD | 0.05 mg | 0.5 ml | 2 | IM/Glut |
| 2 | 5–8 | 1, 2 | — | pCMV 160 dV2 TV1 DNA | 1.0 mg | 0.5 ml | 2 | IM/Quad (Electro) |
| | | 3 | — | pCMV 160 dV2 TV1 DNA | 1.0 mg | 0.5 ml | 2 | IM/Quad (Electro) |
| | | | MF59C | Protein TBD | 0.05 mg | 0.5 ml | 2 | IM/Glut |
| 3 | 9–12 | 1, 2 | — | pCMV 160 dV1/V2 TV1 DNA | 1.0 mg | 0.5 ml | 2 | IM/Quad (Electro) |
| | | 3 | — | pCMV 160 dV1/V2 TV1 DNA | 1.0 mg | 0.5 ml | 2 | IM/Quad (Electro) |
| | | | MF59C | Protein TBD | 0.05 mg | 0.5 ml | 2 | IM/Glut |
| 4 | 13–16 | 1, 2 | — | pCMV 140 TV1 DNA | 1.0 mg | 0.5 ml | 2 | IM/Quad (Electro) |
| | | 3 | — | pCMV 140 TV1 DNA | 1.0 mg | 0.5 ml | 2 | IM/Quad (Electro) |
| | | | MF59C | Protein TBD | 0.05 mg | 0.5 ml | 2 | IM/Glut |
| 5 | 17–20 | 1, 2 | — | pCMV140dV2TV1 DNA | 1.0 mg | 0.5 ml | 2 | IM/Quad (Electro) |
| | | 3 | — | pCMV140dV2TV1 DNA | 1.0 mg | 0.5 ml | 2 | IM/Quad (Electro) |
| | | | MF59C | Protein TBD | 0.05 mg | 0.5 ml | 2 | IM/Glut |
| 6 | 21–24 | 1, 2 | — | pCMV 140 dV1/V2 TV1 DNA | 1.0 mg | 0.5 ml | 2 | IM/Quad (Electro) |
| | | 3 | — | pCMV 140 dV1/V2 TV1 DNA | 1.0 mg | 0.5 ml | 2 | IM/Quad (Electro) |
| | | | MF59C | Protein TBD | 0.05 mg | 0.5 ml | 2 | IM/Glut |

TABLE D-continued

| Grp | Animal | Imm'n # | Adjuvant | Immunogen | Total Dose | Vol/ Site | Sites/ Animal | Route |
|---|---|---|---|---|---|---|---|---|
| 7 | 25–28 | 1, 2 | — | pSIN140dV2SF162 DNA | 1.0 mg | 0.5 ml | 2 | IM/Quad (Electro) |
| | | 3 | — | pSIN 140 dV2 SF162 DNA | 1.0 mg | 0.5 ml | 2 | IM/Quad (Electro) |
| | | | MF59C | Protein TBD | 0.05 mg | 0.5 ml | 2 | IM/Glut |
| 8 | 29–32 | 1, 2 | — | pCMV 140 dV2 SF162 DNA | 1.0 mg | 0.5 ml | 2 | IM/Quad (Electro) |
| | | 3 | — | pCMV 140 dV2 SF162 DNA | 1.0 mg | 0.5 ml | 2 | IM/Quad (Electro) |
| | | | MF59C | Protein TBD | 0.05 mg | 0.5 ml | 2 | IM/Glut |
| 9 | 33–36 | 1, 2 | — | pCMV 140 Q154 SF162 DNA | 1.0 mg | 0.5 ml | 2 | IM/Quad (Electro) |
| | | 3 | — | pCMV 140 Q154 SF162 DNA | 1.0 mg | 0.5 ml | 2 | IM/Quad (Electro) |
| | | | MF59C | Protein TBD | 0.05 mg | 0.5 ml | 2 | IM/Glut |
| 10 | 37–40 | 1, 2 | — | pCMV 140 dV2 SF162 DNA | 1.0 mg | | | |
| | | | | pCMV 140 dV2 TV1 DNA | 1.0 mg | 0.5 ml | 2 | IM/Quad (Electro) |
| | | 3 | — | pCMV 140 dV2 SF162 DNA | 1.0 mg | | | |
| | | | | pCMV 140 dV2 TV1 DNA | 1.0 mg | 0.5 ml | 2 | IM/Quad (Electro) |
| | | | MF59C | Protein TBD | 0.05 mg | 0.5 ml | 2 | IM/Glut |
| | | | — | pCMV 140 dV2 SF162 DNA | 1.0 mg | | | |
| | | | | pCMV 140 dV2 TV1 DNA | 1.0 mg | 0.5 ml | 2 | IM/Quad (Electro) |
| 11 | 41–44 | 1, 2 | — | pCMV 140 dV2 SF162 DNA | 1.0 mg | | | |
| | | | | pCMV 140 dV2 TV1 DNA | 1.0 mg | 0.5 ml | 2 | IM/Quad (Electro) |
| | | 3 | MF59C | Protein TBD | 0.05 mg | 0.5 ml | 2 | IM/Glut |

The MF59C adjuvant is a microfluidized emulsion containing 5% squalene, 0.5% Tween 80, 0.5% span 85, in 10 mM citrate pH 6, stored in 101L aliquots at 4° C.

Immunogens are prepared as described in the following table (Table E) for administration to animals in the various groups. Concentrations may vary from those described in the table, for example depending on the sequences and/or proteins being used.

TABLE E

| Group | Preparation |
|---|---|
| 1–9 | Immunization 1–3: pCMV and pSIN based plasmid DNA in Saline + Electroporation<br>Subtype B and C plasmids will be provided frozen at a concentration of 1.0 mg/ml in sterile 0.9% saline. Store at −80° C. until use. Thaw DNA at room temperature; the material should be clear or slightly opaque, with no particulate matter. Animals will be shaved prior to immunization, under sedation of 1x dose IP (by animal weight) of Ketamine-Xylazine (80 mg/ml − 4 mg/ml). Immunize each rabbit with 0.5 ml DNA mixture per side (IM/Quadriceps), 1.0 ml per animal. Follow the DNA injection with Electroporation using a 6-needle circular array with 1 cm diameter, 1 cm needle length. Electroporation pulses were given at 20 V/mm, 50 ms pulse length, 1 pulse/s.<br>Immunization 3: Protein Immunization<br>Proteins will be provided at 0.1 mg/ml in citrate buffer. Store at −80° C. until use. Thaw at room temperature; material should be clear with no particulate matter. Add equal volume of MF59C adjuvant to thawed protein and mix well by inverting the tube. Immunize each rabbit with 0.5 ml adjuvanted protein per side, IM/Glut for a total of 1.0 ml per animal. Use material within 1 hour of the addition of adjuvant.<br>Immunization 1–3: Combined subtype B and C plasmid DNA in Saline<br>The immunogen will be provided at 2.0 mg/ml total DNA (1 mg/ml of each plasmid) in sterile 0.9% saline. Store at −80° C. until use. Thaw DNA at room temperature; the material should be clear or slightly opaque, with no particulate matter. Animals will be shaved prior to immunization, under sedation of 1x dose IP (by animal weight) of Ketamine-Xylazine (80 mg/ml − 4 mg/ml). Immunize each |

TABLE E-continued

| Group | Preparation |
|---|---|
| | rabbit with 0.5 ml DNA mixture per side (IM/Quadriceps), 1.0 ml per animal. Follow the DNA injection with Electroporation using a 6-needle circular array with 1 cm diameter, 1 cm needle length. Electroporation pulses were given at 20 V/mm, 50 ms pulse length, 1 pulse/s. |
| 10–11 | Immunization 3: Protein Immunization<br>Proteins will be provided at 0.1 mg/ml in citrate buffer. Store at −80° C. until use. Thaw at room temperature; material should be clear with no particulate matter. Add equal volume of MF59C adjuvant to thawed protein and mix well by inverting the tube. Immunize each rabbit with 0.5 ml adjuvanted protein per side, IM/Glut for a total of 1.0 ml per animal. Use material within 1 hour of the addition of adjuvant. |

The immunization (Table F) and bleeding (Table G) schedules are as follows:

TABLE F

| | Imm'n: | | | |
|---|---|---|---|---|
| | 1 | 2 | 3 | 3 |
| | | Weeks: | | |
| Group | 0 | 4 | 16 | 16 |
| 1 | pCMV 160 TV1 DNA | pCMV 160 TV1 DNA | pCMV 160 TV1 DNA | Protein + MF59C |
| 2 | pCMV 160 dV2 TV1 DNA | pCMV 160 dV2 TV1 DNA | pCMV 160 dV2 TV1 DNA | Protein + MF59C |
| 3 | pCMV 160 dV1/V2 TV1 DNA | pCMV 160 dV1/V2 TV1 DNA | pCMV 160 dV1/V2 TV1 DNA | Protein + MF59C |
| 4 | pCMV 140 TV1 DNA | pCMV 140 TV1 DNA | pCMV 140 TV1 DNA | Protein + MF59C |
| 5 | pCMV 140 dV2 TV1 DNA | pCMV 140 dV2 TV1 DNA | pCMV 140 dV2 TV1 DNA | Protein + MF59C |
| 6 | pCMV 140 dV1/V2 TV1 DNA | pCMV 140 dV1/V2 TV1 DNA | pCMV 140 dV1/V2 TV1 DNA | Protein + MF59C |
| 7 | pSIN 140 dV2 SF162 DNA | pSIN 140 dV2 SF162 DNA | pSIN 140 dV2 SF162 DNA | Protein + MF59C |
| 8 | pCMV 140 dV2 SF162 DNA | pCMV 140 dV2 SF162 DNA | pCMV 140 dV2 SF162 DNA | Protein + MF59C |
| 9 | pCMV 140 Q154 SF162 DNA | pCMV 140 Q154 SF162 DNA | pCMV 140 Q154 SF162 DNA | Protein + MF59C |
| 10 | pCMV 140 dV2 SF162 DNA + pCMV 140 dV2 TV1 DNA | pCMV 140 dV2 SF162 DNA + pCMV 140 dV2 TV1 DNA | pCMV 140 dV2 SF162 DNA + pCMV 140 dV2 TV1 DNA | Protein + MF59C |
| 11 | pCMV 140 dV2 SF162 DNA + pCMV 140 dV1/V2 TV1 DNA | pCMV 140 dV2 SF162 DNA + pCMV 140 dV1/V2 TV1 DNA | pCMV 140 dV2 SF162 DNA + pCMV 140 dV1/V2 TV1 DNA | Protein + MF59C |

TABLE G

| | Bleed: | | | | | | | | | | |
|---|---|---|---|---|---|---|---|---|---|---|---|
| | 0 | 1 | 2 | 3 | 4 | 5 | 6 | 7 | 8 | 9 | 10 |
| | | | | | | Week: | | | | | |
| | −3 | 4 | 6 | 8 | 12 | 16 | 18 | 20 | 24 | 28 | TBD |
| Sample: | Clotted Bld. for Serum | Clotted Bld. for Serum | Clotted Bld. for Serum | Clotted Bld. for Serum | Clotted Bld. for Serum | Clotted Bld. for Serum | Clotted Bld. for Serum | Clotted Bld. for Serum | Clotted Bld. for Serum | Clotted Bld. for Serum | Clotted Bld. for Serum |
| Volume: | 20 cc each | 20 cc each | 20 cc each | 20 cc each | 20 cc each | 20 cc each | 20 cc each | 20 cc each | 20 cc each | 20 cc each | 20 cc each |
| Method: | AA/MEV | AA/MEV | AA/MEV | AA/MEV | AA/MEV | AA/MEV | AA/MEV | AA/MEV | AA/MEV | AA/MEV | CP |

EXAMPLE 10

Mice Immunization Studies with Gag and Pol Constructs

Figure 118:
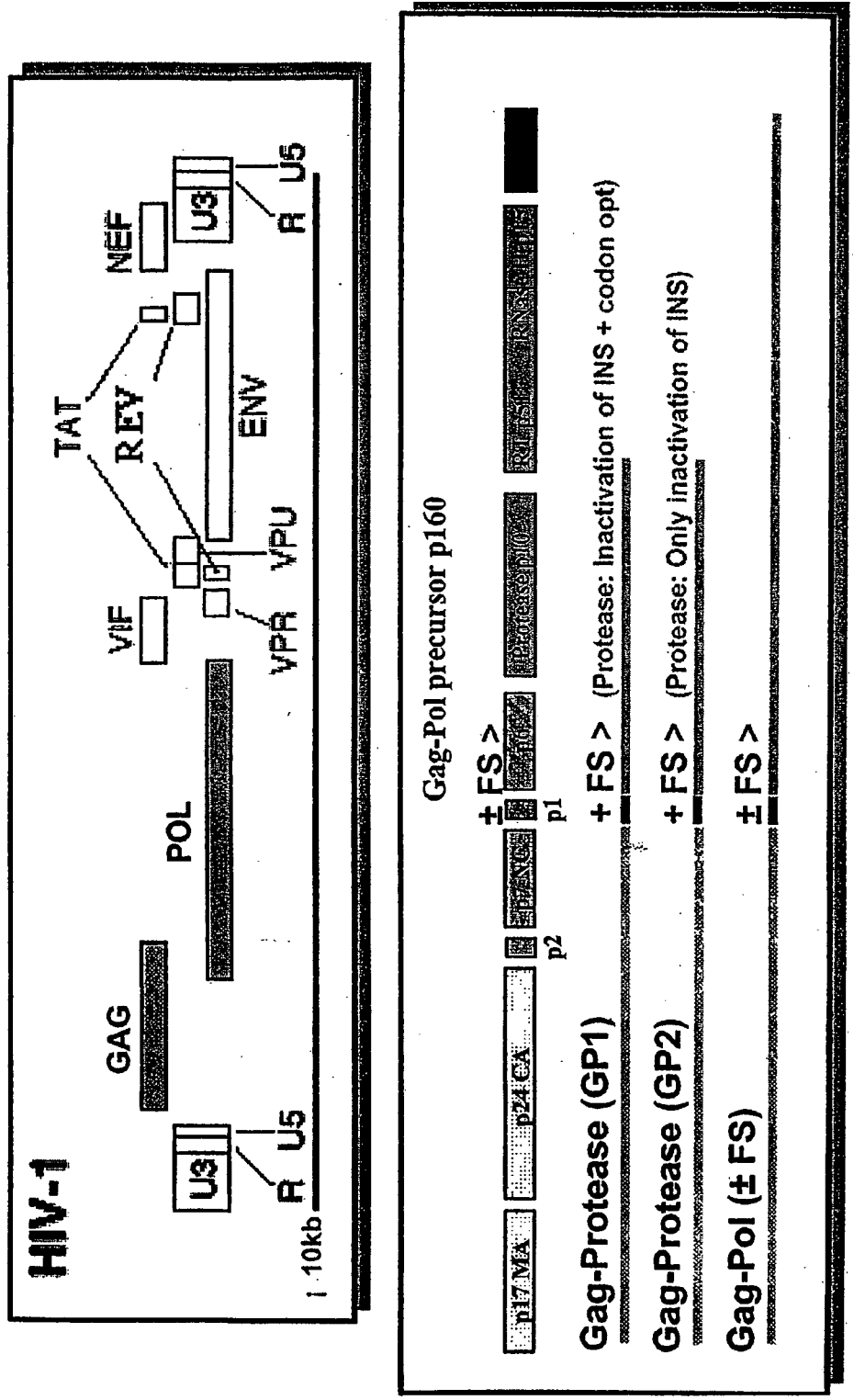
FIG. 118 presents an overview of genome organization of HIV-1 and useful subgenomic fragments.

Cellular and Humoral immune responses were evaluated in mice (essentially as described in Example 4) for the following constructs: Gag, GagProtease(+FS) (GP1, protease codon optimized and inactivation of INS; GP2, protease only inactivation of INS), GagPolΔintegrase with frameshift (gagFSpol), and GagPolΔintegrase in-frame (GagPol) (see FIG. 118). Versions of GagPolΔintegrase in-frame were also designed with attenuated (GagPolAtt) or non-functional Protease (GagPolIna).

In vitro expression data showed comparable expression of p55Gag and p66RT using Gag alone, GagProtease(+FS), GagFSpol and GagPolIna. Constructs with fully functional or attenuated protease (GagPol or GagPolAtt) were less efficient in expression of p55Gag and p66RT, possibly due to cytotoxic effects of protease.

DNA immunization of mice using Gag vs. GP1 and GP2 in pCMV vectors was performed intramuscularly in the tibialis anterior. Mice were immunized at the start of the study (0 week) and 4 weeks later. Bleeds were performed at 0, 4, and 6 weeks. DNA doses used were as follows: 20 μg, 2 μg, 0.2 μg, and 0.02 μg.

DNA immunization of mice using Gag vs. gagFSpol in pCMV vectors was performed intramuscularly in the tibialis anterior. Mice were immunized at the start of the study (0 week) and challenged 4 weeks later with recombinant vaccinia virus encoding Gag (rVVgag). Bleeds were performed at 0 and 4 weeks. DNA doses used were as follows: 20 µg, 2 µg, 0.2 µg, and 0.02 µg.

DNA immunization of mice using Gag vs. gagFSpol and gagpol in pCMV vectors was performed intramuscularly in the tibialis anterior. Mice were immunized at the start of the study (0 week) and challenged 4 weeks later with recombinant vaccinia virus encoding Gag (rVVgag). Bleeds were performed at 0 and 4 weeks. DNA doses used were as follows: 2 µg, 0.2 µg, 0.02 µg, and 0.002 µg.

Cellular immune responses against Gag were comparable for all tested variants, for example, Gag, GagProtease, gagFSpol and GagPolIna all had comparable potencies.

Humoral immune responses to Gag were also comparable with the exception of GP2 and especially GP 1. Humoral immune responses were weaker in constructs comprising functional or attenuated proteases which may be due to less efficient secretion of p55Gag caused by overactive protease.

In vitro and in vivo experiments, performed in support of the present invention, suggest that the expression and immunogenicity of Gag was comparable with all constructs. Exceptions were GagPol in-frame with fully functional or attenuated protease. This may be the result of cytotoxic effects of protease. The immune response in mice correlated with relative levels of expression in vitro.

EXAMPLE 11

Protein Expression, Immunogenicity and Generation of Neutralizing Antibodies Using Type C Derived Envelope Polypeptides Envelope (Env) vaccines derived from the subtype C primary isolate, TV1, recovered from a South African individual, were tested in rabbits as follows. Gene cassettes were designed to express the gp120 (surface antigen), gp140 (surface antigen plus ectodomain of transmembrane protein, gp41), and full-length (gp120 plus gp41) gp160 forms of the HIV-1 envelope polyprotein with and without deletions of the variable loop regions, V2 and V1V2. All of the genes were sequence-modified to enhance expression of the encoded Env glycoproteins in a Rev-independent fashion and they were subsequently cloned into pCMV-based plasmid vectors for DNA vaccine and protein production applications as described above. The sequences were codon optimized as described herein. Briefly, all the modified envelope genes were cloned into the Chiron pCMVlink plasmid vector, preferably into EcoRI/XhoI sites.

A. Protein Expression

Full-length (gp160), truncated gp140 (Env ectodomain only) and gp120 native versions of the TV1 Env antigen were produced from the expression cassettes described herein. The gp140 encoding sequences were transiently transfected into 293T cells. The expression levels of the gene products were evaluated by an in-house antigen capture ELISA. Envelope genes constructed from the native sequences of TV001c8.2, TV001c8.5 and TV002c12.1 expressed the correct proteins in vitro, with gp140TV001c8.2 exhibiting the highest level of expression. In addition, the Env protein expressed from the TV1-derived clone 8.2 was found to bind the CD4 receptor protein indicating that this feature of the expressed protein is maintained in a functional conformation. The receptor binding properties/functionality of the expressed TV1 gp160 protein result was also confirmed by a cell-fusion assay.

Total expression increased approximately 10-fold for synthetic gp140 constructs compared with the native gp140 gene cassettes. Both the modified gp120 and gp140 variants secreted high amounts of protein in the supernatant. In addition, the V2 and V1V2 deleted forms of gp140 expressed approximately 2-fold more protein than the intact gp140. Overall, the expression levels of synthetic gp140 gene variants increased 10 to 26-fold compared with the gp140 gene with native sequences.

In sum, each synthetic construct tested showed more than 10-fold increased levels of expression relative to those using the native coding sequences. Moreover, all expressed proteins were of the expected molecular weights and were shown to bind CD4. Stable CHO cell lines were derived and small-scale protein purification methods were used to produce small quantities of each of the undeleted and V-deleted oligomeric forms (o-gp140) of these proteins for vaccine studies.

B. Neutralization Properties of TV001 and TV002 Viral Isolates

The transient expression experiment showed that the envelope genes derived from the TV001 and TV002 virus isolates expressed the desired protein products. Relative neutralization sensitivities of these two viral strains using sera from 18 infected South African individuals (subtypes B and C) were as follows. At a 1:10 serum dilution, the TV2 strain was neutralized by 18 of 18 sera; at 1:50, 16 of 18; at 1:250, 15/18. In comparison, the TV1 isolate was neutralized by 15 of 18 at 1:10; only 6 of 18 at 1:50; and none of the specimens at 1:250. In addition, the TV001 patient serum showed neutralization activity against the TV002 isolate at all dilutions tested. In contrast, the TV002 showed neutralization of TV001 only at the 1:10 serum dilution. These results suggest that TV001 isolate is capable of inducing a broader and more potent neutralizing antibody response in its infected host than TV002.

C. Immunogenicity of the Modified TV1 Env DNA and Protein Antigens in Rabbit Studies TV1 Env DNA (comprising the synthetic expression cassettes) and protein vaccines were administrated as shown in the following Table H.

TABLE H

| Groups | Plasmid DNA (0, 4, and 20 wks) | Protein boost (20 wks) |
|---|---|---|
| 1 | pCMVgp160.TV1 | o-gp140.TV1 |
| 2 | pCMVgp160dV2.TV1 | o-gp140dV2.TV1 |
| 3 | pCMVgp160dV1V2.TV1 | o-gp140dV1V2.TV1 |
| 4 | pCMVgp140.TV1 | o-gp140.TV1 |
| 5 | pCMVgp140dV2.TV1 | o-gp140dV2.TV1 |
| 6 | pCMVgp140dV1V2.TV1 | o-gp140dV1V2.TV1 |
| 7 | pCMVgp140dV2.SF162 | o-gp140dV2.SF162 |

Seven groups of 4 rabbits per group were immunized with the designated plasmid DNA and oligomeric Env protein antigens. Three doses of DNA, 1 mg of DNA per animal per immunization, were administered intramuscularly by needle injection followed by electroporation on weeks 0, 4, and 20 weeks. A single dose of 100 ug of Env protein in MF59 adjuvant also was given intramuscularly in a separate site at 20 weeks.

The DNA immunization used subtype C sequence-modified genes (TV1)—gp160, gp160dV2, gp160dV1V2, gp140, gp140dV2 and gp140dV1V2—as well as a subtype B SF162 sequence modified gp140dV2. DNA immunizations were performed at 0, 4, and 20 weeks by needle injection by the intramuscular route using electroporation to facilitate transfection of the muscle cells and of resident antigen presenting cells.

A single Env protein booster (in MF59 adjuvant) was given at 20 weeks by intramuscular injection at a separate site. Antibody titers were evaluated by ELISA following each successive immunization. Serum specimens were collected at 0, 4, 6, 8, 12, 22, and 24 weeks. Serum antibody titers were measured on ELISA. 96-well plates were coated with a protein in a concentration of 1ug/ml. Serum samples were diluted serially 3-fold. Goat anti-rabbit peroxidase conjugate (1:20,000) was used for detection. TMB was used as the substrate, and the antibody titers were read at 0.6 OD at 450 nm.

Neutralizing antibody responses against PBMC-grown R5 HIV-1 strains were monitored in the sera collected from the immunized rabbits using two different assays in two different laboratories, the 5.25 reporter cell-line based assay at Chiron and the PBMC-based assay of David Montefiori at Duke University. Results are shown in FIGS. 121, 122, and 123. The Chiron assay was conducted essentially as follows. Neutralizing antibody responses against the PBMC-grown subtype C TV001 and TV002 strains were measured using an in-house reporter cell line assay that uses the 5.25 cell line. This cell has CD4, CCR5, CXCR4 and BONZO receptor/co-receptors on its cell membrane. The parental CEM cell line was derived from a 4-year-old Caucasian female with acute lymphoblastic leukemia, which was fused with the human B cell line 721.174, creating CEMx174. LTR-GFP was transfected into the cells after the CCR5 gene (about 1.1 kb) was cloned into the BamH-I (5') and Sal-I (3') of the pBABE puro retroviral vector, and subsequently introduced into the CEMx174. The green fluorescence protein (GFP) of the cells was detected by flow cytometer (FACScan). For the virus neutralization assay, 50 ul of titrated virus and 50 ul of diluted immune or pre-immune serum were incubated at room temperature for one hour. This mixture was added into wells with $10^4$/ml cells plated in a 24 well plate, and incubated at 37° C. for 5 to 7 days. The cells were then fixed with 2% of formaldehyde after washing with PBS. Fifteen thousand events (cells) were collected for each sample on a Becton Dickinson FACScan using Cellquest software. The data presented were the mean of the triplicate wells. The percent neutralization was calculated compared to the virus control using the following equation: % virus Inhibition=(virus control-experimental)/(virus control-cell control)×100. Any virus inhibition observed in the pre-bleed has been subtracted for each individual animal. Values>50% are considered positive and are highlighted in gray.

In FIG. 122, the "#" indicates that animals had high levels of virus inhibition in pre-bleed serum (>20% virus inhibition) that impacted the magnitude of the observed inhibition and in some cases, our ability to score the serum as a positive or negative for the presence of significant neutralizing-antibody activity (<50% inhibition).

For the data presented in FIG. 123, serum samples were collected after a single protein boost (post-third) were screened in triplicate at a 1:8 dilution with virus (1:24 after addition of cells). Values shown are the % reduction in p24 synthesis relative to that in the corresponding pre-bleed control samples. Zero values indicate no or negative values were measured. NV, not valid due to virus inhibition in pre-immune serum. Neutralization was considered positive when p24 was reduced by at least 80%; these samples are highlighted in dark gray. Sample with lighter gray shading showed at least a 50% reduction in p24 synthesis.

Figure 119:
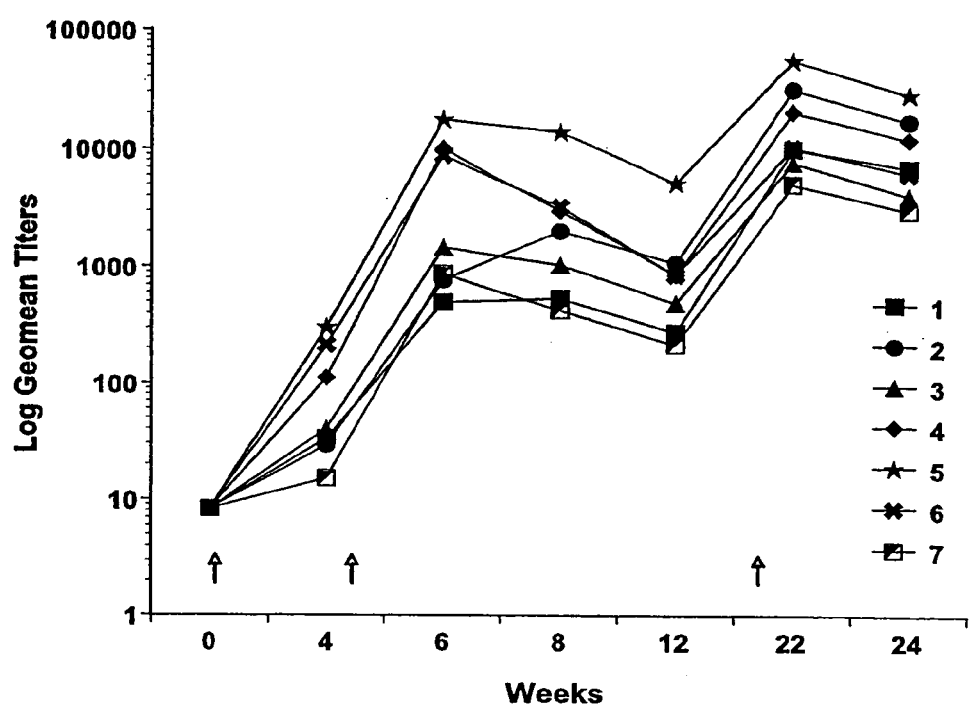
FIG. 119 is a graph depicting log geometric mean antibody titers in immunized rabbbits following immunization with Env DNA and protein.

FIG. 119 shows the ELISA data when plates were coated with the monomeric gp120.TV1 protein. This protein is homologous to the subtype C genes used for the immunization. All immunization groups produced high antibody titers after the second DNA immunization. The groups immunized with gp140 forms of DNA have relatively higher geometric mean antibody titers as compared to the groups using gp160 forms after both first and second DNA immunizations. Both the gp140.TV1 and gp140dV1V2.TV1 genes produced high antibody titers at about $10^4$ at two weeks post second DNA; the gp140dV2.TV1 plasmid yielded the highest titers of antibodies (>$10^4$) at this time point and all others. The binding antibody titers to the gp120.TV1 protein were higher for the group immunized with the homologous gp140dV2.TV1 genes than that with the heterologous gp140dV2.5F162 gene which showed titers of about $10^3$. All the groups, showed some decline in antibody titers by 8 weeks post the second DNA immunization. Following the DNA plus protein booster at 20 weeks, all groups reached titers above that previously observed after the second DNA immunization (0.5–1.0 log increases were observed). After the protein boost, all animals receiving the o-gp140dV2.TV1 protein whether primed by the gp140dV2.TV1 or gp160dV2.TV1 DNA, showed the highest Ab titers.

Figure 120:
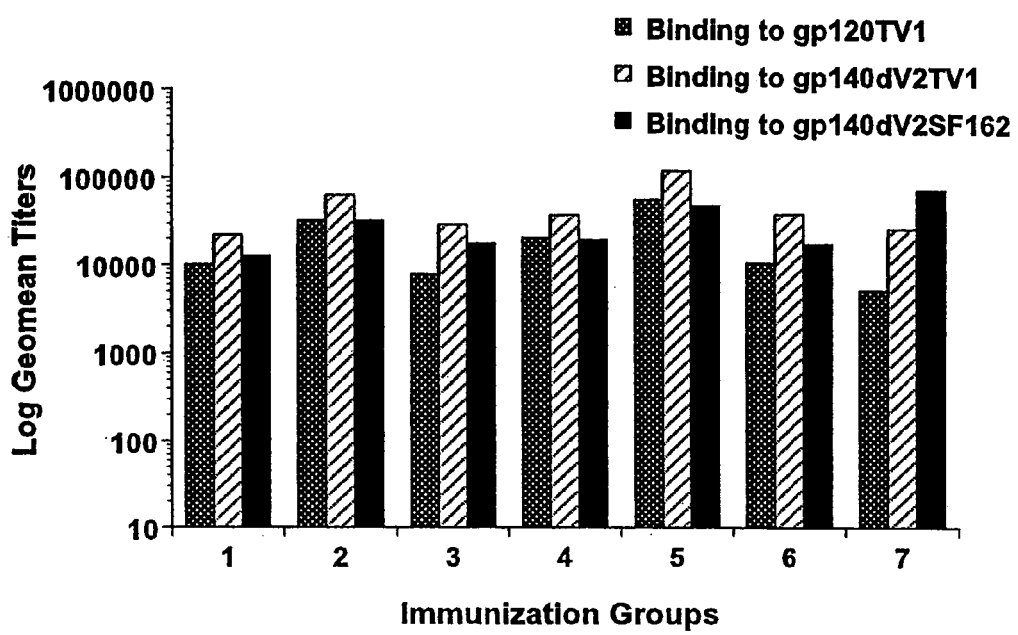

Binding antibody titers were also measured using ELISA plates coated with either oligomeric subtype C o-gp140dV2.TV1 or subtype B o-gp140dV2.5F162 proteins (FIG. 120). For all the TV1 Env immunized groups, the antibody titers measured using the oligomeric protein, o-gp140dV2.TV1 were higher than those measured using the monomeric (non-V2-deleted) protein, gp120.TV1. In fact, for these groups, the titers observed with the heterologous subtype B o-gp140dV2.5F162 protein were comparable to or greater than those measured with the subtype C TV1 gp120. Nevertheless, all groups immunized with subtype C immunogens showed higher titers binding to the subtype C o-gp140dV2.TV1 protein than to the subtype B protein gp140dV2.5F162. Conversely, the group immunized with the gp140dV2.5F162 immunogen showed higher antibody titers with the oligomeric subtype B protein relative its subtype C counterpart. Overall, all three assays demonstrated that high antibody cross-reactive antibodies were generated by the subtype CTV1-based DNA and protein immunogens.

The results indicate that the subtype C TV1-derived Env DNA and protein antigens are immunogenic inducing high titers of antibodies in immunized rabbits and substantial evidence of neutralizing antibodies against both subtype B and subtype C R5 virus strains. In particular, the gp140dV2.TV1 antigens have induced consistent neutralizing responses against the subtype B SF162EnvDV2 and subtype C TV2 strains. Thus, TV1-based Env DNA and protein-based antigens are immunogenic and induce high titer antibody responses reactive with both subtype C and subtype B HIV-1 Env antigens. Neutralizing antibody responses against the neutralization sensitive subtype B R5 HIV-1$_{SF162Dv2}$ strain were observed in some groups after only two DNA immunizations. Following a single booster immunization with Env protein, the majority of rabbits in groups that received V2-deleted forms of the TV1 Env showed neutralization activity against the closely related subtype C TV2 primary strain.

EXAMPLE 12

Immunological Responses in Rhesus Macagues

Cellular and humoral immune responses were evaluated in three groups of rhesus macaques (each group was made up of four animals) in an immunization study structured as shown in Table I. The route of administration for the immunizing composition was electroporation in each case. Antibody titers are shown in Table I for two weeks post-second immunization.

TABLE I

| Group | Formulation of Immunizing Composition* | Animal # | Titer |
|---|---|---|---|
| 1 | pCMVgag (3.5 mg) + pCMVenv (2.0 mg) | A | 3,325 |
|   |   | B | 4,000 |
|   |   | C (previously immunized with HCV core ISCOMS, rVVC core E1) | 1,838 |
|   |   | D (previously immunized with HCV core ISCOMS, rVVC core E1) | 1,850 |
| 2 | pCMVgag (3.5 mg) + pCMVpol (4.2 mg) | A (previously immunized with HCV core ISCOMS, rVVC core E1, p55gag$_{LAI}$(VLP)) | 525 |
|   |   | B | 5,313 |
|   |   | C | 6,450 |
|   |   | D | 5,713 |
| 3 | pCMVgag-pol (5.0 mg) | A (previously immunized with HCV core ISCOMS, rVVC core E1, pCMVgagSF2) | 0 |
|   |   | B (previously immunized with rVVC/E1, pCMV Epo-Epi, HIV/HCV-VLP, pCMVgagSF2, pUCgp120 SF2) | 1,063 |
|   |   | C | 513 |
|   |   | D (previously immunized with rVVC/E1, HIV/HCV-VLP) | 713 |

*pCMVgag = pCMVKm2.GagMod Type C Botswana
pCMVenv = pCMVLink.gp140env.dV2.TV1 (Type C)
pCMVpol = pCMVKm2.p2Pol.mut.Ina Type C Botswana
pCMVgag-pol = pCMVKm2.gagCpol.mut.Ina Type C Botswana Pre-immune sera were obtained at week 0 before the first immunization. The first immunization was given at week 0. The second immunization was given at week 4. The first bleed was performed at 2 weeks post-second immunization (i.e., at week 6). A third immunization will be given at week 8 and a fourth at week 16. Animals 2A, 3A, 3B and 3D had been vaccinated previously (approximately 4 years or more) with gag plasmid DNA or gag VLP (subtype B).

Bulk CTL, $^{51}$Cr-release assays, and flow cell cytometry methods were used to obtain the data in Tables J and K. Reagents used for detecting gag- and pol-specific T-cells were (i) synthetic, overlapping peptides spanning "gagCpol" antigen (n=377), typically the peptides were pools of 15-mers with overlap by 11, the pools were as follows, pool 1, n=1–82, pool 2, n=83–164, pool 3, n=165–271, pool 4, n=272–377, accordingly pools 1 and 2 are "gag"-specific, and pools 3 and 4 are "pol"-specific, and (ii) recombinant vaccinia virus (rVV), for example, rVVgag965, rVVp2Pol975 (contains p2p7gag975), and VV$_{wr}$parent.

Gag-specific IFNγ +CD8+T-cells, Gag-specific IFNγ+ CD4+T-cells, Pol-specific IFNγ+CD8+T-cells, and Pol-specific IFNγ+CD4+T-cells in blood were determined for each animal described in Table I above, post second immunization. The results are presented in Tables J and K. It is possible that some of the pol-specific activity shown in Table K was directed against p2p7gag.

TABLE J

Gag Assay Results

| | | Gag Specific CD4 + Responses | | | Gag Specific CD8 + Responses | | |
|---|---|---|---|---|---|---|---|
| | | LPA (SI) | | Flow | CTL | | Flow |
| Group/Animal | Immunizing Composition | p55 | Pool 1 | Pool 2 | IFNg + | Pool 1 | Pool 2 | IFNg + |
| 1A | pCMVgag pCMVenv | 3.3 | 5.9 | 3.8 | 496 | minus | minus | 225 |
| 1B | pCMVgag pCMVenv | 11.8 | 4.4 | 1.5 | 786 | minus | minus | 160 |
| 1C | pCMVgag pCMVenv | 5.7 | 1.1 | 2.4 | 361 | plus | plus | 715 |
| 1D | pCMVgag pCMVenv | 6.5 | 3.1 | 1.6 | 500 | plus | ? | 596 |
| 2A | pCMVgag pCMVpol | 4.8 | 4.8 | 1.6 | 405 | plus | minus | 1136 |

TABLE J-continued

Gag Assay Results

| Group/Animal | Immunizing Composition | Gag Specific CD4 + Responses | | | | Gag Specific CD8 + Responses | | |
|---|---|---|---|---|---|---|---|---|
| | | LPA (SI) | | | Flow | CTL | | Flow |
| | | p55 | Pool 1 | Pool 2 | IFNg + | Pool 1 | Pool 2 | IFNg + |
| 2B | pCMVgag pCMVpol | 12.5 | 6.8 | 3.3 | 1288 | plus | minus | 2644 |
| 2C | pCMVgag pCMVpol | 6.0 | 3.8 | 2.1 | 776 | minus | minus | 0 |
| 2D | pCMVgag pCMVpol | 18.9 | 13.5 | 5.4 | 1351 | minus | minus | 145 |
| 3A | pCMV gagpol | 12.2 | 7.0 | 1.5 | 560 | plus | plus | 3595 |
| 3B | pCMV gagpol | 2.7 | 5.6 | 1.3 | 508 | plus | ? | 3256 |
| 3C | pCMV gagpol | 11.6 | 5.0 | 1.2 | 289 | minus | ? | 617 |
| 3D | pCMV gagpol | 1.5 | 1.2 | 1.4 | 120 | minus | minus | 277 |

? = might be positive on rVVp2Pol.

TABLE K

Pol Assay Results

| Group/Animal | Immunizing Composition | Pol Specific CD4 + Response | | | Pol Specific CD8 + Responses | | |
|---|---|---|---|---|---|---|---|
| | | LPA (SI) | | Flow | CTL | | Flow |
| | | Pool 3 | Pool 4 | IFNg + | Pool 3 | Pool 4 | IFNg + |
| 1A | pCMVgag pCMVenv | 1 | 1.2 | 0 | minus | minus | 0 |
| 1B | pCMVgag pCMVenv | 1 | 1 | 0 | minus | minus | 0 |
| 1C | pCMVgag pCMVenv | 1 | 1.1 | 0 | minus | minus | 0 |
| 1D | pCMVgag pCMVenv | 1.2 | 1.3 | 0 | minus | minus | 262 |
| 2A | pCMVgag pCMVpol | 1.1 | 0.9 | 92 | minus | minus | 459 |
| 2B | pCMVgag pCMVpol | 2.5 | 1.8 | 107 | minus | minus | 838 |
| 2C | pCMVgag pCMVpol | 1.2 | 1.1 | 52 | plus | minus | 580 |
| 2D | pCMVgag pCMVpol | 2.5 | 2.7 | 113 | plus | plus | 5084 |
| 3A | pCMV gagpol | 2.7 | 2.4 | 498 | minus | minus | 3631 |
| 3B | pCMV gagpol | 1.1 | 1 | 299 | minus | minus | 1346 |
| 3C | pCMV gagpol | 2.1 | 1.4 | 369 | minus | minus | 399 |
| 3D | pCMV gagpol | 1.3 | 1.8 | 75 | minus | minus | 510 |

These results support that the constructs of the present invention are capable of generating specific cellular and humoral responses against the selected HIV-polypeptide antigens.

Although preferred embodiments of the subject invention have been described in some detail, it is understood that obvious variations can be made without departing from the spirit and the scope of the invention as defined by the appended claims.

SEQUENCE LISTING (319 sequences)

SEQ ID NO: 1 - DNA, 9781 bp, Artificial Sequence
  Description of Artificial Sequence: 8_5_TV1_C.ZA
tggaagggttaatttactccaagaaaaggcaagaaatccttgatttgtgggtctatcacacacaaggcttcttccctgattggcaaaactacacaccggggccaggggtcagatatccactgacctttggatggtgctacaagctagtgccagttgacccaggggaggtggaagaggccaacggaggagaagacaactgtttgctacaccctatgagccaacatggagcagaggatgaagatagagaagtattaaagtggaagtttgacagcctcctagcacgcagacacatggcccgcgagctacatccggagtattacaaagactgctgacacagaagggactttccgcctgggactttccactggggcgttccgggaggtgtggtctgggcgggacttgggagtggtcaaccctcagatgctgcatataagcagctgcttttcgcctgtactgggtctctctcggtagaccagatctgagcctgggagccctctggctatctagggaacccactgcttaagcctcaataaagcttgccttgagtgctttaagtagtgtgtgcccatctgttgtgtgactctggtaactagagatccctcagaccctttgtggtagtgtggaaaatctctagcagtggcgcccgaacagggaccagaaagtgaaagtgagaccagaggagatctctcgacgcaggactcggcttgctgaagtgcacacggcaagaggcgagaggggcggctggtgagtacgccaattttacttgactagcggaggctagaaggagagagatgggtgcgagagcgtcaatattaagcggcggaaaattagataaatgggaaagaattaggttaaggccagggggaaagaaacattatatgttaaaacatctagtatgggcaagcagggagctggaaagatttgcacttaaccctggcctgttagaaacatcagaaggctgtaaacaaataataaaacagctacaaccagctcttcagacaggaacagaggaacttagatcattattcaacacagtagcaactctctattgtgtacataaagggatagaggtacgagacaccaaggaagccttagacaagatagaggaagaacaaaacaaatgtcagcaaaaagcacaacaggcaaaagcagctgacgaaaaggtcagtcaaaattatcctatagtacagaatgcccaagggcaaatggtacaccaagctatatcacctagaacattgaatgcatggataaaagtaatagaggaaaaggctttcaatccagaggaaatacccatgtttacagcattatcagaaggagccaccccacaagatttaaacacaatgttaaatacagtggggggacatcaagcagccatgcaaatgttaaaagataccatcaatgaggaggctgcagaatgggataggacacatccagtacatgcagggcctgttgcaccaggccagatgagagaaccaaggggaagtgacatagcaggaactactagtacccttcaggaacaaatagcatggatgacaagtaatccacctattccagtagaagacatctataaaagatggataattctggggttaaataaaatagtaagaatgtatagccctgttagcattttggacataaaacaagggccaaaagaaccctttagagactatgtagaccggttctttaaaaccttaagagctgaacaagctacacaagatgtaaagaattggatgacagacaccttgttggtccaaaatgcgaacccagattgtaagaccattttaagagcattaggaccaggggcctcattagaagaaatgatgacagcatgtcagggagtgggaggacctagccataaagcaagagtgttggctgaggcaatgagccaagcaaacagtaacatactagtgcagagaagcaattttaaaggctctaacagaattattaaatgtttcaactgtggcaaagtagggcacatagccagaaattgcagggcccctaggaaaaagggctgttggaaatgtggacaggaaggacaccaaatgaaagactgtactgagaggcaggctaattttttagggaaaatttggccttcccacaaggggaggccagggaatttcctccagaacagaccagagccaacagccccaccagcagaaccaacagccccaccagcagagagcttcaggttcgaggagacaacccccgtgccgaggaaggagaaagagagggaacctttaacttccctcaaatcactctttggcagcgaccccttgtctcaataaaagtagagggccagataaaggaggctctcttagacacaggagcagatgatacagtattagaagaaatagatttgccagggaaatggaaaccaaaaatgatagggggaattggaggttttatcaaagtaagacagtatgatcaaatacttatagaaatttgtggaaaaaaggctataggtacagtattagtagggcctacaccagtcaacataattggaagaaatctgttaactcagcttggatgcacactaaattttccaattagtcctattgaaactgtaccagtaaaattaaaaccaggaatggatggcccaaaggtcaaacaatggccattgacagaagaaaaaataaaagcattaacagcaatttgtgaggaaatggagaaggaaggaaaaattacaaaaattgggcctgataatccatataacactccagtatttgccataaaaaagaaggacagtactaagtggagaaaattagtagatttcagggaactcaataaaagaactcaagacttttgggaagttcaattaggaataccacacccagcaggattaaaaaagaaaaaatcagtgacagtgctagatgtgggggatgcatatttttcagttcctttagatgaaagcttcaggaaatatactgcattcaccatacctagtataaacaatgaaacaccagggattagatatcaatataatgtgctgccacagggatggaaaggatcaccagcaatattccagagtagcatgacaaaaatcttagagcccttcagagcaaaaaatccagacatagttatctatcaatatatggatgacttgtatgtaggatctgacttagaaatagggcaacatagagcaaaaatagaagagttaagggaacatttattgaaatggggatttacaacaccagacaagaaacatcaaaaagaacccccatttctttggatggggtatgaactccatcctgacaaatggacagtacaacctatactgctgccagaaaaggatagttggactgtcaatgatatacagaagttagtgggaaaattaaactgggcaagtcagatttacccagggattaaagtaaggcaactctgtaaactcctcaggggggccaaagcactaacagacatagtaccactaactgaagaagcagaattagaattggcagagaacagggaaattttaagagaaccagtacatggagtatattatgatccatcaaaagacttgatagctgaaatacagaaacaggggcatgaacaatggacatatcaaatttatcaagaaccatttaaaaatctgaaaacagggaagtatgcaaaaatgaggactacccacactaatgatgtaaaacagttaacagaggcagtgcaaaaaatagccatggaaagcatagtaatatggggaaagactcctaaatttagactacccatccaaaaagaaacatgggagacatggtggacagactattggcaagccacctggatccctgagtgggagtttgttaatacccctcccctagtaaaattatggtaccaactagaaaaagatcccatagcaggagtagaaactttctatgtagatggagcaactaatagggaagctaaaataggaaaagcagggtatgttactgacagaggaaggcagaaaattgttactctaactaacacaacaaatcagaagactgagttacaagcaattcagctagctctgcaggattcaggatcagaagtaaacatagtaacagactcacagtatgcattaggaatcattcaagcacaaccagataagagtgactcagagatatttaaccaaataatagaacagttaataaacaaggaaagaatctacctgtcatgggtaccagcacataaaggaattgggggaaatgaacaagtagataaattagtaagtaagggaattaggaaagtgttgtttctagatggaatagataaagctcaagaagagcatgaaaggtaccacagcaattggagagcaatggctaatgagtttaatctgccacccatagtagcaaaagaaatagtagctagctgtgataaatgtcagctaaaaggggaagccatacatggacaagtcgactgtagtccagggatatggcaattagattgtacccatttagagggaaaaatcatcctggtagcagtccatgtagctagtggctacatggaagcagaggttatcccagcagaaacaggacaagaaacagcatattttatattaaaattagcaggaagatggccagtcaaagtaatacatacagacaatggcagtaattttaccagtactgcagttaaggcagcctgttggtgggcaggtatccaacaggaatttggaattccctacaatccccaaagtcagggagtggtagaatccatgaataaagaattaaagaaaataataggacaagtaagagatcaagctgagcaccttaagacagcagtacaaatggcagtattcattcacaattttaaaagaaaagggggaattggggggtacagtgcaggggaaagaataatagacataatagcaacagacatacaaactaaagaattacaaaaacaaattataagaattcaaaattttcgggtttattacagagacagcagagaccctatttggaaaggaccagccgaactactctggaaaggtgaaggggtagtagtaatagaagataaaggtgacataaaggtagtaccaaggaggaaagcaaaaatcattagagattatggaaaacagatggcaggtgctgattgtgtggcaggtggacaggatgaagattagagcatggaatagtttagtaaagcaccatatgtatatatcaaggagagctagtggatgggtctacagacatcattttgaaagcagacatccaaaagtaagttcagaagtacatatcccattaggggatgctagattagtaataaaaacatattggggtttgcagacaggagaaagagattggcatttgggtcatggagtctccatagaatggagactgagagaatacagcacacaagtagaccctgacctggcagaccagctaattcacatgcattattttgattgttttacagaatctgccataagacaagccatattaggacacatagtttttcctaggtgtgactatcaagcaggacataagaaggtaggatctctgcaatacttggcactgacagcattgataaaaccaaaaaagagaaagccacctctgcctagtgttagaaaattagtagaggatagatggaacgacccccagaagaccaggggccgcagagggaaccatacaatgaatggacactagagattctagaagaactcaagcaggaagctgtcagacactttcctagaccatggctccatagcttaggacaatatatctatgaaacctatggggatacttggacgggagttgaagctataataagagtactgcaacaactactgttcattcatttcagaattggatgccaacatagcagaataggcatcttgcgacagagaagagcaagaaatggagccagtagatcctaaactaaagccctggaaccatccaggaagccaacctaaaacagcttgtaataattgcttttgcaaacactgtagctatcattgtctagtttgctttcagacaaaaggtttaggcatttcctatggcaggaagaagcggagacagcgacgaagcgctcctccaagtggtgaagatcatcaaaatcctctatcaaagcagtaagtacacatagtagatgtaatggtaagtttaagtttatttaaaggagtagattatagattaggagtaggagcattgatagtagcactaatcatagcaataatagtgtggaccatagcatatatagaatataggaaattggtaagacaaaagaaaatagactggttaattaaaagaattagggaaagagcagaagacagtggcaatgagagtgatggggacacagaagaattgtcaacaatggtggatatggggcatcttaggcttctggatgctaatgatttgtaacacggaggacttgtgggtcacagtctactatggggtacctgtgtggagagaagcaaaaactactctattctgtgcatcagatgctaaagcatatgagacagaagtgcataatgtctgggctacacatgcttgtgtacccacagaccccaacccacaagaaatagttttgggaaatgtaacagaaaattttaatatgtggaaaaataacatggcagatcagatgcatgaggatataatcagtttatgggatcaaagcctaaagccatgtgtaaagttgaccccactctgtgtcactttaaactgtacagatacaaatgttacaggtaatagaactgttacaggtaatacaaatgataccaatattgcaaatgctacatataagtatgaagaaatgaaaaattgctctttcaatgcaaccacagaattaagagataagaaacataaagagtatgcactcttttataaacttgatatagtaccacttaatgaaaatagtaacaactttacatatagattaataaattgcaatacctcaaccataacacaagcctgtccaaaggtctcttttgacccgattcctatacattactgtgctccagctgattatgcgattctaaagtgtaataataagacattcaatgggacaggaccatgttataatgtcagcacagtacaatgtacacatggaattaagccagtggtatcaactcaactactgttaaatggtagtctagcagaagaagggataataattagatctgaaaatttgacagagaataccaaaacaataatagtacatcttaatgaatctgtagagattaattgtacaaggcccaacaataatacaaggaaaagtgtaaggataggaccaggacaagcattctatgcaacaaatgacgtaataggaaacataagacaagcacattgtaacattagtacagatagatggaataaaactttacaacaggtaatgaaaaaattaggagagcatttccctaataaaacaataaaatttgaaccacatgcaggaggggatctagaaattacaatgcatagctttaattgtagaggagaatttttctattgcaatacatcaaacctgtttaatagtacatactaccctaagaatggtacatacaaatacaatggtaattcaagcttacccatcacactccaatgcaaaataaaacaaattgtacgcatgtggcaaggggtaggacaagcaatgtatgcccctcccattgcaggaaacataacatgtagatcaaacatcacaggaatactattgacacgtgatgggggatttaacaacacaaacaacgacacagaggagacattcagacctggaggaggagatatgagggataactggagaagtgaattatataaatataaagtggtagaaattaagccattgggaatagcacccactaaggcaaaaagaagagtggtgcagagaaaaaaaagagcagtgggaataggagctgtgttccttgggttcttgggagcagcaggaagcactatgggcgcagcgtcaataacgctgacggtacaggccagacaactgttgtctggtatagtgcaacagcaaagcaatttgctgaaggctatagaggcgcaacagcatatgttgcaactcacagtctggggcattaagcagctccaggcgagagtcctggctatagaaagatacctaaaggatcaacagctcctagggatttggggctgctctggaagactcatctgcaccactgctgtgccttggaactccagttggagtaataaatctgaagcagatatttgggataacatgacttggatgcagtgggatagagaaattaataattacacagaaacaatattcaggttgcttgaagactcgcaaaaccagcaggaaaagaatgaaaaagatttattagaattggacaagtggaataatctgtggaattggtttgacatatcaaactggctgtggtatataaaaatattcataatgatagtaggaggcttgataggtttaagaataatttttgctgtgctctctatagtgaatagagttaggcagggatactcacctttgtcatttcagacccttaccccaagcccgaggggactcgacaggctcggaggaatcgaagaagaaggtggagagcaagacagagacagatccatacgattggtgagcggattcttgtcgcttgcctgggacgatctgcggagcctgtgcctcttcagctaccaccgcttgagagacttcatattaattgcagtgagggcagtggaacttctgggacacagcagtctcaggggactacagagggggtgggagatccttaagtatctgggaagtcttgtgcagtattggggtctagagctaaaaaagagtgctattagtccgcttgataccatagcaatagcagtagctgaaggaacagataggattatagaattggtacaaagaatttgtagagctatcctcaacatacctaggagaataagacagggctttgaagcagctttgctataaaatgggaggcaagtggtcaaaacgcagcatagttggatggcctgcagtaagagaaagaatgagaagaactgagccagcagcagagggagtaggagcagcgtctcaagacttagatagacatggggcacttacaagcagcaacacacctgctactaatgaagcttgtgcctggctgcaagcacaagaggaggacggagatgtaggctttccagtcagacctcaggtacctttaagaccaatgacttataagagtgcagtagatctcagcttctttttaaaagaaaaggggggactggaagggttaatttactctaggaaaaggcaagaaatccttgatttgtgggtctataacacacaaggcttcttccctgattggcaaaactacacatcggggccaggggtccgattcccactgacctttggatggtgcttcaagctagtaccagttgacccaagggaggtgaaagaggccaatgaaggagaagacaactgtttgctacaccctatgagccaacatggagcagaggatgaagatagagaagtattaaagtggaagtttgacagccttctagcacacagacacatggcccgcgagctacatccggagtattacaaagactgctgacacagaagggactttccgcctgggactttccactggggcgttccgggaggtgtggtctgggcgggacttgggagtggtcaccctcagatgctgcatataagcagctgcttttcgcttgtactgggtctctctcggtagaccagatctgagcctgggagctctctggctatctagggaacccactgcttaggcctcaataaagcttgccttgagtgctctaagtagtgtgtgcccatctgttgtgtgactctggtaactagagatccctcagaccctttgtggtagtgtggaaaatctctagca

SEQ ID NO: 2 - protein, 842 aa, Artificial Sequence
  Description of Artificial Sequence: SF162
MDAMKRGLCCVLLLCGAVFVSPSAVEKLWVTVYYGVPVWKEATTTLFCASDAKAYDTEVHNVWATHACVPTDPNPQEIVLENVTENFNMWKNNMVEQMHEDIISLWDQSLKPCVKLTPLCVTLHCTNLKNATNTKSSNWKEMDRGEIKNCSFKVTTSIRNKMQKEYALFYKLDVVPIDNDNTSYKLINCNTSVITQACPKVSFEPIPIHYCAPAGFAILKCNDKKFNGSGPCTNVSTVQCTHGIRPVVSTQLLLNGSLAEEGVVIRSENFTDNAKTIIVQLKESVEINCTRPNNNTRKSITIGPGRAFYATGDIIGDIRQAHCNISGEKWNNTLKQIVTKLQAQFGNKTIVFKQSSGGDPEIVMHSFNCGGEFFYCNSTQLFNSTWNNTIGPNNTNGTITLPCRIKQIINRWQEVGKAMYAPPIRGQIRCSSNITGLLLTRDGGKEISNTTEIFRPGGGDMRDNWRSELYKYKVVKIEPLGVAPTKAKRRVVQREKRAVTLGAMFLGFLGAAGSTMGARSLTLTVQARQLLSGIVQQQNNLLRAIEAQQHLLQLTVWGIKQLQARVLAVERYLKDQQLLGIWGCSGKLICTTAVPWNASWSNKSLDQIWNNMTWMEWEREIDNYTNLIYTLIEESQNQQEKNEQELLELDKWASLWNWFDISKWLWYIKIFIMIVGGLVGLRIVFTVLSIVNRVRQGYSPLSFQTRFPAPRGPDRPEGIEEEGGERDRDRSSPLVHGLLALIWDDLRSLCLFSYHRLRDLILIAARIVELLGRRGWEALKYWGNLLQYWIQELKNSAVSLFDAIAIAVAEGTDRIIEVAQRIGRAFLHIPRRIRQGFERALL

SEQ ID NO: 3 - protein, 867 aa, Artificial Sequence
  Description of Artificial Sequence: TV1.8_2
MRVMGTQKNCQQWWIWGILGFWMLMICNTEDLWVTVYYGVPVWRDAKTTLFCASDAKAYETEVHNVWATHACVPTDPNPQEIVLGNVTENFNMWKNDMADQMHEDVISLWDQSLKPCVKLTPLCVTLNCTDTNVTGNRTVTGNSTNNTNGTGIYNIEEMKNCSFNATTELRDKKHKEYALFYRLDIVPLNENSDNFTYRLINCNTSTITQACPKVSFDPIPIHYCAPAGYAILKCNNKTFNGTGPCYNVSTVQCTHGIKPVVSTQLLLNGSLAEEGIIIRSENLTENTKTIIVHLNESVEINCTRPNNNTRKSVRIGPGQAFYATNDVIGNIRQAHCNISTDRWNKTLQQVMKKLGEHFPNKTIQFKPHAGGDLEITMHSFNCRGEFFYCNTSNLFNSTYHSNNGTYKYNGNSSSPITLQCKIKQIVRMWQGVGQATYAPPIAGNITCRSNITGILLTRDGGFNTTNNTETFRPGGGDMRDNWRSELYKYKVVEIKPLGIAPTKAKRRVVQREKRAVGIGAVFLGFLGAAGSTMGAASITLTVQARQLLSGIVQQQSNLLKAIEAQQHMLQLTVWGIKQLQARVLAIERYLKDQQLLGIWGCSGRLICTTAVPWNSSWSNKSEKDIWDNMTWMQWDREISNYTGLIYNLLEDSQNQQEKNEKDLLELDKWNNLWNWFDISNWPWYIKIFIMIVGGLIGLRIIFAVLSIVNRVRQGYSPLSFQTLTPSPRGLDRLGGIEEEGGEQDRDRSIRLVSGFLSLAWDDLRNLCLFSYHRLRDFILIAVRAVELLGHSSLRGLQRGWEILKYLGSLVQYWGLELKKSAISLLDTIAITVAEGTDRIIELVQRICRAILNIPRRIRQGFEAALL

SEQ ID NO: 4 - protein, 869 aa, Artificial Sequence
  Description of Artificial Sequence: TV1.8_5
MRVMGTQKNCQQWWIWGILGFWMLMICNTEDLWVTVYYGVPVWREAKTTLFCASDAKAYETEVHNVWATHACVPTDPNPQEIVLGNVTENFNMWKNNMADQMHEDIISLWDQSLKPCVKLTPLCVTLNCTDTNVTGNRTVTGNTNDTNIANATYKYEEMKNCSFNATTELRDKKHKEYALFYKLDIVPLNENSNNFTYRLINCNTSTITQACPKVSFDPIPIHYCAPADYAILKCNNKTFNGTGPCYNVSTVQCTHGIKPVVSTQLLLNGSLAEEGIIIRSENLTENTKTIIVHLNESVEINCTRPNNNTRKSVRIGPGQAFYATNDVIGNIRQAHCNISTDRWNKTLQQVMKKLGEHFPNKTIKFEPHAGGDLEITMHSFNCRGEFFYCNTSNLFNSTYYPKNGTYKYNGNSSLPITLQCKIKQIVRMWQGVGQAMYAPPIAGNITCRSNITGILLTRDGGFNNTNNDTEETFRPGGGDMRDNWRSELYKYKVVEIKPLGIAPTKAKRRVVQRKKRAVGIGAVFLGFLGAAGSTMGAASITLTVQARQLLSGIVQQQSNLLKAIEAQQHMLQLTVWGIKQLQARVLAIERYLKDQQLLGIWGCSGRLICTTAVPWNSSWSNKSEADIWDNMTWMQWDREINNYTETIFRLLEDSQNQQEKNEKDLLELDKWNNLWNWFDISNWLWYIKIFIMIVGGLIGLRIIFAVLSIVNRVRQGYSPLSFQTLTPSPRGLDRLGGIEEEGGEQDRDRSIRLVSGFLSLAWDDLRSLCLFSYHRLRDFILIAVRAVELLGHSSLRGLQRGWEILKYLGSLVQYWGLELKKSAISPLDTIAIAVAEGTDRIIELVQRICRAILNIPRRIRQGFEAALL

SEQ ID NO: 5 - protein, 854 aa, Artificial Sequence
  Description of Artificial Sequence: TV2.12-5/1
MRARGILKNYRHWWIWGILGFWMLMMCNVKGLWVTVYYGVPVGREAKTTLFCASDAKAYEKEVHNVWATHACVPTDPNPQEVILGNVTENFNMWKNDMVDQMQEDIISLWDQSLKPCVKLTPLCVTLNCTNATVNYNNTSKDMKNCSFYVTTELRDKKKKENALFYRLDIVPLNNRKNGNINNYRLINCNTSAITQACPKVSFDPIPIHYCAPAGYAPLKCNNKKFNGIGPCDNVSTVQCTHGIKPVVSTQLLLNGSLAEEEIIIRSENLTNNVKTIIVHLNESIEIKCTRPGNNTRKSVRIGPGQAFYATGDIIGDIRQAHCNISKNEWNTTLQRVSQKLQELFPNSTGIKFAPHSGGDLEITTHSFNCGGEFFYCNTTDLFNSTYSNGTCTNGTCMSNNTERITLQCRIKQIINMWQEVGRAMYAPPIAGNITCRSNITGLLLTRDGGDNNTETETFRPGGGDMRDNWRSELYKYKVVEIKPLGVAPTAAKRRVVEREKRAVGIGAVFLGFLGAAGSTMGAASITLTVQARQLLSGIVQQQSNLLRAIEAQQHMLQLTVWGIKQLQARVLAIERYLQDQQLLGLWGCSGKLICTTNVLWNSSWSNKTQSDIWDNMTWMQWDREISNYTNTIYRLLEDSQSQQERNEKDLLALDRWNNLWNWFSITNWLWYIKIFIMIVGGLIGLRIIFAVLSLVNRVRQGYSPLSLQTLIPNPRGPDRLGGIEEEGGEQDSSRSIRLVSGFLTLAWDDLRSLCLFCYHRLRDFILIVVRAVELLGHSSLRGLQRGWGTLKYLGSLVQYWGLELKKSAINLLDTIAIAVAEGTDRILEFIQNLCRGIRNVPRRIRQGFEAALQ

SEQ ID NO: 6 - protein, 860 aa, Artificial Sequence
  Description of Artificial Sequence: consensus sequence
MRVMGTQKNCQQWWIWGILGFWMLMICNVEDLWVTVYYGVPVWREAKTTLFCASDAKAYETEVHNVWATHACVPTDPNPQEIVLGNVTENFNMWKNNMVDQMHEDIISLWDQSLKPCVKLTPLCVTLNCTNTNVTGNRTVTGNSNSNAAYEEMKNCSFNVTTELRDKKHKEYALFYKLDIVPLNNENSNNFTYRLINCNTSTITQACPKVSFDPIPIHYCAPAGYAILKCNNKTFNGTGPCYNVSTVQCTHGIKPVVSTQLLLNGSLAEEGIIIRSENLTENTKTIIVHLNESVEINCTRPNNNTRKSVRIGPGQAFYATNDIIGNIRQAHCNISTDRWNKTLQQVMKKLQEHFPNKTIKFKPHAGGDLEITMHSFNCRGEFFYCNTSNLFNSTYHNNGTYKYNGNSSPITLQCKIKQIIRMWQGVGQAMYAPPIAGNITCRSNITGILLTRDGGFNNTNTTETFRPGGGDMRDNWRSELYKYKVVEIKPLGIAPTKAKRRVVQREKRAVGIGAVFLGFLGAAGSTMGAASITLTVQARQLLSGIVQQQSNLLKAIEAQQHMLQLTVWGIKQLQARVLAIERYLKDQQLLGIWGCSGKLICTTAVPWNSSWSNKSEADIWDNMTWMQWDREISNYTNTIYRLLEDSQNQQEKNEKDLLELDKWNNLWNWFDISNWLWYIKIFIMIVGGLIGLRIIFAVLSIVNRVRQGYSPLSFQTLTPSPRGPDRLGGIEEEGGEQDRDRSIRLVSGFLSLAWDDLRSLCLFSYHRLRDFILIAVRAVELLGHSSLRGLQRGWEILKYLGSLVQYWGLELKKSAISLLDTIAIAVAEGTDRIIELVQRICRAILNIPRRIRQGFEAALL

SEQ ID NO: 7 - protein, 4 aa, Artificial Sequence
  Description of Artificial Sequence: catalytic center
YMDD

SEQ ID NO: 8 - protein, 4 aa, Artificial Sequence
  Description of Artificial Sequence: primer grip region
WMGY

SEQ ID NO: 9 - DNA, 3930 bp, Artificial Sequence
  Description of Artificial Sequence: GagComplPolmut_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagaattcgccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggacaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 10 - DNA, 3930 bp, Artificial Sequence
  Description of Artificial Sequence: GagComplPolmutAtt_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagaattcgccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggactccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 11 - DNA, 3930 bp, Artificial Sequence
  Description of Artificial Sequence: GagComplPolmutIna_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagaattcgccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 12 - DNA, 5145 bp, Artificial Sequence
  Description of Artificial Sequence: GagComplPolmutInaTatRevNef_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagaattcgccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctagggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 13 - DNA, 3531 bp, Artificial Sequence
  Description of Artificial Sequence: GagPolmut_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaactttaaaaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggacaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 14 - DNA, 3537 bp, Artificial Sequence
  Description of Artificial Sequence: GagPolmutAtt_C
gtcgacgccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaactttaaaaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggactccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 15 - DNA, 3537 bp, Artificial Sequence
  Description of Artificial Sequence: GagPolmutIna_C
gtcgacgccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaactttaaaaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 16 - DNA, 3462 bp, Artificial Sequence
  Description of Artificial Sequence: GagProtInaRTmut_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccagaaagaattcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctcgcttaa

SEQ ID NO: 17 - DNA, 4716 bp, Artificial Sequence
  Description of Artificial Sequence: GagProtInaRTmutTatRevNef_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccagaaagaattcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctcaagcttgagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 18 - DNA, 3162 bp, Artificial Sequence
  Description of Artificial Sequence: GagRTmut_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccagaaagaattccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctctaa

SEQ ID NO: 19 - DNA, 4419 bp, Artificial Sequence
  Description of Artificial Sequence: GagRTmutTatRevNef_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccagaaagaattccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctcaagcttgagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 20 - DNA, 2742 bp, Artificial Sequence
  Description of Artificial Sequence: GagTatRevNef_C
gccaccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagaattcgagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 21 - DNA, 1281 bp, Artificial Sequence
  Description of Artificial Sequence: gp120mod.TV1.del118-210
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgggcgccggcgcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgctaa

SEQ ID NO: 22 - DNA, 1329 bp, Artificial Sequence
  Description of Artificial Sequence: gp120mod.TV1.delV1V2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgggcgccggcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgctaa

SEQ ID NO: 23 - DNA, 1461 bp, Artificial Sequence
  Description of Artificial Sequence: gp120mod.TV1.delV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgctaa

SEQ ID NO: 24 - DNA, 1794 bp, Artificial Sequence
  Description of Artificial Sequence: gp140mod.TV1.del118-210
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgggcgccggcgcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 25 - DNA, 1842 bp, Artificial Sequence
  Description of Artificial Sequence: gp140mod.TV1.delV1V2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgggcgccggcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 26 - DNA, 1974 bp, Artificial Sequence
  Description of Artificial Sequence: gp140mod.TV1.delV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 27 - DNA, 2061 bp, Artificial Sequence
  Description of Artificial Sequence: gp140mod.TV1.mut7
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccatcagcagcgtggtgcagagcgagaagagcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 28 - DNA, 2049 bp, Artificial Sequence
  Description of Artificial Sequence: gp140mod.TV1.tpa2
atggatgcaatgaagagagggctctgctgtgtgctgctgctgtgtggagcagtcttcgtttcgcccagcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 29 - DNA, 2127 bp, Artificial Sequence
  Description of Artificial Sequence: gp140TMmod.TV1
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtg

SEQ ID NO: 30 - DNA, 2337 bp, Artificial Sequence
  Description of Artificial Sequence: gp160mod.TV1.del118-210
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgggcgccggcgcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaa

SEQ ID NO: 31 - DNA, 1842 bp, Artificial Sequence; identical to SEQ ID NO: 25
  Description of Artificial Sequence: gp160mod.TV1.delV1V2

SEQ ID NO: 32 - DNA, 2517 bp, Artificial Sequence
  Description of Artificial Sequence: gp160mod.TV1.delV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaa

SEQ ID NO: 33 - DNA, 2508 bp, Artificial Sequence
  Description of Artificial Sequence: gp160mod.TV1.dV1
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgggcgccggcaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaa

SEQ ID NO: 34 - DNA, 4606 bp, Artificial Sequence
  Description of Artificial Sequence: gp160mod.TV1.dV1-gagmod.BW965
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgggcgccggcaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaactcgagcaagtctagagggagaccacaacggtttccctctagcgggatcaattccgcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaataa

SEQ ID NO: 35 - DNA, 4483 bp, Artificial Sequence
  Description of Artificial Sequence: gp160mod.TV1.dV1V2-gagmod.BW965
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgggcgccggcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaactcgagcaagtctagagggagaccacaacggtttccctctagcgggatcaattccgcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaataa

SEQ ID NO: 36 - DNA, 4615 bp, Artificial Sequence
  Description of Artificial Sequence: gp160mod.TV1.dV2-gagmod.BW965
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaactcgagcaagtctagagggagaccacaacggtttccctctagcgggatcaattccgcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaataa

SEQ ID NO: 37 - DNA, 2592 bp, Artificial Sequence
  Description of Artificial Sequence: gp160mod.TV1.tpa2
atggatgcaatgaagagagggctctgctgtgtgctgctgctgtgtggagcagtcttcgtttcgcccagcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaa

SEQ ID NO: 38 - DNA, 4702 bp, Artificial Sequence
  Description of Artificial Sequence: gp160mod.TV1-gagmod.BW965
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatcaagatcttcatcatgatcgtgggcggcctgatcggcctgcgcatcatcttcgccgtgctgagcatcgtgaaccgcgtgcgccagggctacagccccctgagcttccagaccctgacccccagcccccgcggcctggaccgcctgggcggcatcgaggaggagggcggcgagcaggaccgcgaccgcagcatccgcctggtgagcggcttcctgagcctggcctgggacgacctgcgcaacctgtgcctgttcagctaccaccgcctgcgcgacttcatcctgatcgccgtgcgcgccgtggagctgctgggccacagcagcctgcgcggcctgcagcgcggctgggagatcctgaagtacctgggcagcctggtgcagtactggggcctggagctgaagaagagcgccatcagcctgctggacaccatcgccatcaccgtggccgagggcaccgaccgcatcatcgagctggtgcagcgcatctgccgcgccatcctgaacatcccccgccgcatccgccagggcttcgaggccgccctgctgtaactcgagcaagtctagagggagaccacaacggtttccctctagcgggatcaattccgcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatgggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaataa

SEQ ID NO: 39 - DNA, 861 bp, Artificial Sequence
  Description of Artificial Sequence: int.opt.mut_C
ttcctggacggcatcgacaaggcccaggaggagcacgagcgctaccacagcaactggcgcgccatggccaacgagttcaacctgccccccatcgtggccaaggagatcgtggccagcgccgacaagtgccagctgaagggcgaggccatccacggccaggtggactgcagccccggcatctggcagctggcctgcacccacctggagggcaagatcatcctggtggccgtgcacgtggccagcggctacatggaggccgaggtgatccccgccgagaccggccaggagaccgcctacttcatcctgaagctggccggccgctggcccgtgaaggtgatccacaccgccaacggcagcaacttcaccagcaccgccgtgaaggccgcctgctggtgggccggcatccagcaggagttcggcatcccctacaacccccagagccagggcgtggtggcgagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcatcgacatcatcgccaccgacatccagaccaaggagctgcagaagcagatcatccgcatccagaacttccgcgtgtactaccgcgacagccgcgaccccatcaagggccccgccgagctgctgtggaagggcgagggcgtggtggtgatcgaggacaagggcgacatcaaggtggtgccccgccgcaaggccaagatcatccgcgactacggcaagcagatggccggcgccgactgcgtggccggcggccaggacgaggac

SEQ ID NO: 40 - DNA, 864 bp, Artificial Sequence
  Description of Artificial Sequence: int.opt_C
ttcctggacggcatcgacaaggcccaggaggagcacgagcgctaccacagcaactggcgcgccatggccaacgagttcaacctgccccccatcgtggccaaggagatcgtggccagctgcgacaagtgccagctgaagggcgaggccatccacggccaggtggactgcagccccggcatctggcagctggactgcacccacctggagggcaagatcatcctggtggccgtgcacgtggccagcggctacatggaggccgaggtgatccccgccgagaccggccaggagaccgcctacttcatcctgaagctggccggccgctggcccgtgaaggtgatccacaccgacaacggcagcaacttcaccagcaccgccgtgaaggccgcctgctggtgggccggcatccagcaggagttcggcatcccctacaacccccagagccagggcgtggtggagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcatcgacatcatcgccaccgacatccagaccaaggagctgcagaagcagatcatccgcatccagaacttccgcgtgtactaccgcgacagccgcgaccccatctggaagggccccgccgagctgctgtggaagggcgagggcgtggtggtgatcgaggacaagggcgacatcaaggtggtgccccgccgcaaggccaagatcatccgcgactacggcaagcagatggccggcgccgactgcgtggccggcggccaggacgaggac

SEQ ID NO: 41 - DNA, 570 bp, Artificial Sequence
  Description of Artificial Sequence: nef.D106G.-myr19.opt_C
atgatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcc

SEQ ID NO: 42 - DNA, 360 bp, Artificial Sequence
  Description of Artificial Sequence: p15RnaseH.opt_C
tacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctc

SEQ ID NO: 43 - DNA, 2445 bp, Artificial Sequence
  Description of Artificial Sequence: p2Pol.opt.YMWM_C
gccaccatggccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggt

SEQ ID NO: 44 - DNA, 2457 bp, Artificial Sequence
  Description of Artificial Sequence: p2Polopt.YM_C
gtcgacgccaccatggccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgtggatgggctacgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggt

SEQ ID NO: 45 - DNA, 2457 bp, Artificial Sequence
  Description of Artificial Sequence: p2Polopt_C
gccaccatggccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggacaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccagtacatggacgacctgtacgtgggcagcgacctggagatcggccagcaccgcgccaagatcgaggagctgcgcaagcacctgctgcgctggggcttcaccacccccgacaagaagcaccagaaggagccccccttcctgtggatgggctacgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggt

SEQ ID NO: 46 - DNA, 3597 bp, Artificial Sequence
  Description of Artificial Sequence: p2PolTatRevNef opt C
gtcgacgccaccatggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgaattcgccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgtaa

SEQ ID NO: 47 - DNA, 3624 bp, Artificial Sequence
  Description of Artificial Sequence: p2PolTatRevNef.opt.native_C
gccaccatggccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggacaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccagtacatggacgacctgtacgtgggcagcgacctggagatcggccagcaccgcgccaagatcgaggagctgcgcaagcacctgctgcgctggggcttcaccacccccgacaagaagcaccagaaggagccccccttcctgtggatgggctacgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctggaattcgagcccgtggaccccaacctggagccctggaaccaccccggcagccagcccaagaccgcctgcaacaagtgctactgcaagcactgcagctaccactgcctggtgtgcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggcccgcaagaaccgccgccgccgctggcgcgcccgccagcgccagatccacagcatcagcgagcgcatcctgagcacctgcctgggccgccccgccgagcccgtgcccttccagctgccccccatcgagcgcctgcacatcgactgcagcgagagcagcggcaccagcggcacccagcagagccagggcaccaccgagggcgtgggcagccccctcgagggcggcaagtggagcaagagcagcatcgtgggctggcccgccgtgcgcgagcgcatccgccgcaccgagcccgcccgcgagggcgccgccgagggcgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccgactggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgc

SEQ ID NO: 48 - DNA, 3607 bp, Artificial Sequence
  Description of Artificial Sequence: p2PolTatRevNef.opt_C
gtcgacgccaccatggccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctggaattcgagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaaatctaga

SEQ ID NO: 49 - DNA, 1971 bp, Artificial Sequence
  Description of Artificial Sequence: protInaRT.YM.opt_C
ccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgtggatgggctacgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctc

SEQ ID NO: 50 - DNA, 1965 bp, Artificial Sequence
  Description of Artificial Sequence: protInaRT.YMWM.opt_C
ccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctc

SEQ ID NO: 51 - DNA, 3234 bp, Artificial Sequence
  Description of Artificial Sequence: ProtRT.TatRevNef.opt_C
gccaccatgccccagatcaccctgtggcagcgccccctggtgagcatcaaggtgggcggccagatcaaggaggccctgctggacaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctcgaattcgagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 52 - DNA, 321 bp, Artificial Sequence
  Description of Artificial Sequence: rev.exon1_2.M5-10.opt_C
atggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagcccc

SEQ ID NO: 53 - DNA, 1257 bp, Artificial Sequence
  Description of Artificial Sequence: tat.exon1_2.opt.C22-37_C
atggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 54 - DNA, 303 bp, Artificial Sequence
  Description of Artificial Sequence: tat.exon1_2.opt.C37_C
atggagcccgtggaccccaacctggagccctggaaccaccccggcagccagcccaagaccgcctgcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgac

SEQ ID NO: 55 - DNA, 1275 bp, Artificial Sequence
  Description of Artificial Sequence: TatRevNef.opt.native_ZA
atggagcccgtggaccccaacctggagccctggaaccaccccggcagccagcccaagaccgcctgcaacaagtgctactgcaagcactgcagctaccactgcctggtgtgcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggcccgcaagaaccgccgccgccgctggcgcgcccgccagcgccagatccacagcatcagcgagcgcatcctgagcacctgcctgggccgccccgccgagcccgtgcccttccagctgccccccatcgagcgcctgcacatcgactgcagcgagagcagcggcaccagcggcacccagcagagccagggcaccaccgagggcgtgggcagccccctcgagggcggcaagtggagcaagagcagcatcgtgggctggcccgccgtgcgcgagcgcatccgccgcaccgagcccgcccgcgagggcgccgccgagggcgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccgactggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgc

SEQ ID NO: 56 - DNA, 1257 bp, Artificial Sequence; identical to SEQ ID NO: 53
  Description of Artificial Sequence: TatRevNef.opt_ZA

SEQ ID NO: 57 - DNA, 2742 bp, Artificial Sequence
  Description of Artificial Sequence: TatRevNefGag C
gccaccatggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgaattcggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagcctaa

SEQ ID NO: 58 - DNA, 5184 bp, Artificial Sequence
  Description of Artificial Sequence: TatRevNefgagCpolIna C
gccaccatggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcctcgagggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccaagaattcgccgaggccatgagccaggccaccagcgccaacatcctgatgcagcgcagcaacttcaagggccccaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcttccgcgaggacctggccttcccccagggcaaggcccgcgagttccccagcgagcagaaccgcgccaacagccccaccagccgcgagctgcaggtgcgcggcgacaacccccgcagcgaggccggcgccgagcgccagggcaccctgaacttcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctgttcctggacggcatcgatggcggcatcgtgatctaccagtacatggacgacctgtacgtgggcagcggcggccctaggatcgattaaaagcttcccggggctagcaccggttctaga

SEQ ID NO: 59 - DNA, 4713 bp, Artificial Sequence
  Description of Artificial Sequence: TatRevNefGagProtInaRTmut C
gccaccatggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcaagcttggcgcccgcgccagcatcctgcgcggcggcaagctggacgcctgggagcgcatccgcctgcgccccggcggcaagaagtgctacatgatgaagcacctggtgtgggccagccgcgagctggagaagttcgccctgaaccccggcctgctggagaccagcgagggctgcaagcagatcatccgccagctgcaccccgccctgcagaccggcagcgaggagctgaagagcctgttcaacaccgtggccaccctgtactgcgtgcacgagaagatcgaggtccgcgacaccaaggaggccctggacaagatcgaggaggagcagaacaagtgccagcagaagatccagcaggccgaggccgccgacaagggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacacgatgttgaacaccgtgggcggccaccaggccgccatgcagatgctgaaggacaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcgcctggatgaccagcaacccccccatccccgtgggcgacatctacaagcggtggatcatcctgggcctgaacaagatcgtgcggatgtacagccccgtgagcatcctggacatcaagcagggccccaaggagcccttccgcgactacgtggaccgcttcttcaagaccctgcgcgccgagcagagcacccaggaggtgaagaactggatgaccgacaccctgctggtgcagaacgccaaccccgactgcaagaccatcctgcgcgctctcggccccggcgccagcctggaggagatgatgaccgcctgccagggcgtgggcggccccagccacaaggcccgcgtgctggccgaggcgatgagccaggccaacaccagcgtgatgatgcagaagagcaacttcaagggcccccggcgcatcgtcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccggccagaagcaggagagcaaggaccgcgagaccctgaccagcctgaagagcctgttcggcaacgaccccctgagccagaaagaattcccccagatcaccctgtggcagcgccccctggtgagcatcaaggtgggcggccagatcaaggaggccctgctggccaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctctaa

SEQ ID NO: 60 - DNA, 3231 bp, Artificial Sequence
  Description of Artificial Sequence: TatRevNefProtRT opt C
gccaccatggagcccgtggaccccaacctggagccctggaaccaccccggcagccagcccaagaccgccggcaacaagtgctactgcaagcactgcagctaccactgcctggtgagcttccagaccaagggcctgggcatcagctacggccgcaagaagcgccgccagcgccgcagcgccccccccagcagcgaggaccaccagaaccccatcagcaagcagcccctgccccagacccgcggcgaccccaccggcagcgaggagagcaagaagaaggtggagagcaagaccgagaccgaccccttcgaccccggggccggccgcagcggcgacagcgacgaggccctgctgcaggccgtgcgcatcatcaagatcctgtaccagagcaacccctaccccaagcccgagggcacccgccaggccgacctgaaccgccgccgccgctggcgcgcccgccagcgccagatccacagcatcagcgagcgcatcctgagcacctgcctgggccgccccgccgagcccgtgcccttccagctgccccccgacctgcgcctgcacatcgactgcagcgagagcagcggcaccagcggcacccagcagagccagggcaccaccgagggcgtgggcagccccctcgaggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcctgctgcaccccatgagccagcacggcatggaggacgaggaccgcgaggtgctgaagtggaagttcgacagcagcctggcccgccgccacatggcccgcgagctgcaccccgagtactacaaggactgcgaattcccccagatcaccctgtggcagcgccccctggtgagcatcaaggtgggcggccagatcaaggaggccctgctggacaccggcgccgacgacaccgtgctggaggagatgagcctgcccggcaagtggaagcccaagatgatcggcggcatcggcggcttcatcaaggtgcgccagtacgaccagatcctgatcgagatctgcggcaagaaggccatcggcaccgtgctgatcggccccacccccgtgaacatcatcggccgcaacatgctgacccagctgggctgcaccctgaacttccccatcagccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagaagaagaagagcgtgaccgtgctggacgtgggcgacgcctacttcagcgtgcccctggacgaggacttccgcaagtacaccgccttcaccatccccagcatcaacaacgagacccccggcatccgctaccagtacaacgtgctgccccagggctggaagggcagccccagcatcttccagagcagcatgaccaagatcctggagcccttccgcgcccgcaaccccgagatcgtgatctaccaggcccccctgtacgtgggcagcgacctggagatcggccagcaccgcgccaagatcgaggagctgcgcaagcacctgctgcgctggggcttcaccacccccgacaagaagcaccagaaggagccccccttcctgcccatcgagctgcaccccgacaagtggaccgtgcagcccatcgagctgcccgagaaggagagctggaccgtgaacgacatccagaagctggtgggcaagctgaactgggccagccagatctaccccggcatcaaggtgcgccagctgtgcaagctgctgcgcggcgccaaggccctgaccgacatcgtgcccctgaccgaggaggccgagctggagctggccgagaaccgcgagatcctgcgcgagcccgtgcacggcgtgtactacgaccccagcaaggacctggtggccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagagcatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagatcggcaaggccggctacgtgaccgaccggggccggcagaagatcgtgagcctgaccgagaccaccaaccagaagaccgagctgcaggccatccagctggccctgcaggacagcggcagcgaggtgaacatcgtgaccgacagccagtacgccctgggcatcatccaggcccagcccgacaagagcgagagcgagctggtgaaccagatcatcgagcagctgatcaagaaggagaaggtgtacctgagctgggtgcccgcccacaagggcatcggcggcaacgagcagatcgacaagctggtgagcaagggcatccgcaaggtgctctaa

SEQ ID NO: 61 - DNA, 2604 bp, Artificial Sequence
  Description of Artificial Sequence: Env of clone TV001c8.2 of isolate C-98TV001
atgagagtgatggggacacagaagaattgtcaacaatggtggatatggggcatcttaggcttctggatgctaatgatttgtaacacggaggacttgtgggtcacagtctactatggggtacctgtgtggagagacgcaaaaactactctattctgtgcatcagatgctaaagcatatgagacagaagtgcataatgtctgggctacacatgcctgtgtacccacagaccccaacccacaagaaatagttttgggaaatgtaacagaaaattttaatatgtggaaaaatgacatggcagatcagatgcatgaggatgtaatcagtttatgggatcaaagcctaaagccatgtgtaaagttgaccccactctgtgtcactttaaactgtacagatacaaatgttacaggtaatagaactgttacaggtaatagtaccaataatacaaatggtacaggtatttataacattgaagaaatgaaaaattgctctttcaatgcaaccacagaattaagagataagaaacataaagagtatgcactcttttatagacttgatatagtaccacttaatgagaatagtgacaactttacatatagattaataaattgcaatacctcaaccataacacaagcctgtccaaaggtctcttttgacccgattcctatacattactgtgctccagctggttatgcgattctaaagtgtaataataagacattcaatgggacaggaccatgttataatgtcagcacagtacaatgtacacatggaattaagccagtggtatcaactcaattactgttaaatggtagtctagcagaagaagggataataattagatctgaaaatttgacagagaataccaaaacaataatagtacaccttaatgaatctgtagagattaattgtacaagacccaacaataatacaagaaaaagtgtaaggataggaccaggacaagcattctatgcaacaaatgatgtaataggaaacataagacaagcacattgtaacattagtacagatagatggaacaaaactttacaacaggtaatgaaaaaattaggagagcatttccctaataaaacaatacaatttaaaccacatgcaggaggggatctagaaattacaatgcatagctttaattgtagaggagaatttttctattgtaatacatcaaacctgtttaatagcacataccactctaataatggtacatacaaatacaatggtaattcaagctcacccatcacactccaatgtaaaataaaacaaattgtacgcatgtggcaaggggtaggacaagcaacgtatgcccctcccattgcaggaaacataacatgtagatcaaacatcacaggaatactattgacacgtgatggaggatttaacaccacaaacaacacagagacattcagacctggaggaggagatatgagggataactggagaagtgaattatataaatataaagtagtagaaattaagccattgggaatagcacccactaaggcaaaaagaagagtggtgcagagagaaaaaagagcagtgggaataggagctgtgttccttgggttcttgggagcagcaggaagcactatgggcgcagcgtcaataacgctgacggtacaggccagacaactgttgtctggtatagtgcaacagcaaagcaatttgctgaaggctatagaggcgcaacagcatatgttgcaactcacagtctggggcattaagcagctccaggcgagagtcctggctatagaaagatacctaaaggatcaacagctcctagggatttggggctgctctggaagactcatctgcaccactgctgtgccttggaactccagttggagtaataaatctgaaaaagatatttgggataacatgacttggatgcagtgggatagagaaattagtaattacacaggcttaatatacaatttgcttgaagactcgcaaaaccagcaggaaaagaatgaaaaagatttattagaattggacaagtggaacaatctgtggaattggtttgacatatcaaactggccgtggtatataaaaatattcataatgatagtaggaggcttgataggtttaagaataatttttgctgtgctttctatagtgaatagagttaggcagggatactcacctttgtcatttcagacccttaccccaagcccgaggggactcgacaggctcggaggaatcgaagaagaaggtggagagcaagacagagacagatccatacgattggtgagcggattcttgtcgcttgcctgggacgatctgcggaacctgtgcctcttcagctaccaccgcttgagagacttcatattaattgcagtgagggcagtggaacttctgggacacagcagtctcaggggactacagagggggtgggaaatccttaagtatctgggaagtcttgtgcaatattggggtctagagctaaaaaagagtgctattagtctgcttgataccatagcaataacagtagctgaaggaacagataggattatagaattagtacaaagaatttgtagagctatcctcaacatacctagaagaataagacagggctttgaagcagctttgctataa

SEQ ID NO: 62 - DNA, 2610 bp, Artificial Sequence
  Description of Artificial Sequence: Env of clone TV001c8.5 of isolate C-98TV001
atgagagtgatggggacacagaagaattgtcaacaatggtggatatggggcatcttaggcttctggatgctaatgatttgtaacacggaggacttgtgggtcacagtctactatggggtacctgtgtggagagaagcaaaaactactctattctgtgcatcagatgctaaagcatatgagacagaagtgcataatgtctgggctacacatgcttgtgtacccacagaccccaacccacaagaaatagttttgggaaatgtaacagaaaattttaatatgtggaaaaataacatggcagatcagatgcatgaggatataatcagtttatgggatcaaagcctaaagccatgtgtaaagttgaccccactctgtgtcactttaaactgtacagatacaaatgttacaggtaatagaactgttacaggtaatacaaatgataccaatattgcaaatgctacatataagtatgaagaaatgaaaaattgctctttcaatgcaaccacagaattaagagataagaaacataaagagtatgcactcttttataaacttgatatagtaccacttaatgaaaatagtaacaactttacatatagattaataaattgcaatacctcaaccataacacaagcctgtccaaaggtctcttttgacccgattcctatacattactgtgctccagctgattatgcgattctaaagtgtaataataagacattcaatgggacaggaccatgttataatgtcagcacagtacaatgtacacatggaattaagccagtggtatcaactcaactactgttaaatggtagtctagcagaagaagggataataattagatctgaaaatttgacagagaataccaaaacaataatagtacatcttaatgaatctgtagagattaattgtacaaggcccaacaataatacaaggaaaagtgtaaggataggaccaggacaagcattctatgcaacaaatgacgtaataggaaacataagacaagcacattgtaacattagtacagatagatggaataaaactttacaacaggtaatgaaaaaattaggagagcatttccctaataaaacaataaaatttgaaccacatgcaggaggggatctagaaattacaatgcatagctttaattgtagaggagaatttttctattgcaatacatcaaacctgtttaatagtacatactaccctaagaatggtacatacaaatacaatggtaattcaagcttacccatcacactccaatgcaaaataaaacaaattgtacgcatgtggcaaggggtaggacaagcaatgtatgcccctcccattgcaggaaacataacatgtagatcaaacatcacaggaatactattgacacgtgatgggggatttaacaacacaaacaacgacacagaggagacattcagacctggaggaggagatatgagggataactggagaagtgaattatataaatataaagtggtagaaattaagccattgggaatagcacccactaaggcaaaaagaagagtggtgcagagaaaaaaaagagcagtgggaataggagctgtgttccttgggttcttgggagcagcaggaagcactatgggcgcagcgtcaataacgctgacggtacaggccagacaactgttgtctggtatagtgcaacagcaaagcaatttgctgaaggctatagaggcgcaacagcatatgttgcaactcacagtctggggcattaagcagctccaggcgagagtcctggctatagaaagatacctaaaggatcaacagctcctagggatttggggctgctctggaagactcatctgcaccactgctgtgccttggaactccagttggagtaataaatctgaagcagatatttgggataacatgacttggatgcagtgggatagagaaattaataattacacagaaacaatattcaggttgcttgaagactcgcaaaaccagcaggaaaagaatgaaaaagatttattagaattggacaagtggaataatctgtggaattggtttgacatatcaaactggctgtggtatataaaaatattcataatgatagtaggaggcttgataggtttaagaataatttttgctgtgctctctatagtgaatagagttaggcagggatactcacctttgtcatttcagacccttaccccaagcccgaggggactcgacaggctcggaggaatcgaagaagaaggtggagagcaagacagagacagatccatacgattggtgagcggattcttgtcgcttgcctgggacgatctgcggagcctgtgcctcttcagctaccaccgcttgagagacttcatattaattgcagtgagggcagtggaacttctgggacacagcagtctcaggggactacagagggggtgggagatccttaagtatctgggaagtcttgtgcagtattggggtctagagctaaaaaagagtgctattagtccgcttgataccatagcaatagcagtagctgaaggaacagataggattatagaattggtacaaagaatttgtagagctatcctcaacatacctaggagaataagacagggctttgaagcagctttgctataa

SEQ ID NO: 63 - DNA, 2565 bp, Artificial Sequence
  Description of Artificial Sequence: Env of clone TV001c12.1 of isolate C-98TV002
atgagagcgagggggatactgaagaattatcgacactggtggatatggggcatcttaggcttttggatgctaatgatgtgtaatgtgaagggcttgtgggtcacagtctactacggggtacctgtggggagagaagcaaaaactactctattttgtgcatcagatgctaaagcatatgagaaagaagtgcataatgtctgggctacacatgcctgtgtacccacagaccccaacccacaagaagtgattttgggcaatgtaacagaaaattttaacatgtggaaaaatgacatggtggatcagatgcaggaagatataatcagtttatgggatcaaagccttaagccatgtgtaaaattgaccccactctgtgtcactttaaactgtacaaatgcaactgttaactacaataatacctctaaagacatgaaaaattgctctttctatgtaaccacagaattaagagataagaaaaagaaagaaaatgcacttttttatagacttgatatagtaccacttaataataggaagaatgggaatattaacaactatagattaataaattgtaatacctcagccataacacaagcctgtccaaaagtctcgtttgacccaattcctatacattattgtgctccagctggttatgcgcctctaaaatgtaataataagaaattcaatggaataggaccatgcgataatgtcagcacagtacaatgtacacatggaattaagccagtggtatcaactcaattactgttaaatggtagcctagcagaagaagagataataattagatctgaaaatctgacaaacaatgtcaaaacaataatagtacatcttaatgaatctatagagattaaatgtacaagacctggcaataatacaagaaagagtgtgagaataggaccaggacaagcattctatgcaacaggagacataataggagatataagacaagcacattgtaacattagtaaaaatgaatggaatacaactttacaaagggtaagtcaaaaattacaagaactcttccctaatagtacagggataaaatttgcaccacactcaggaggggacctagaaattactacacatagctttaattgtggaggagaatttttctattgcaatacaacagacctgtttaatagtacatacagtaatggtacatgcactaatggtacatgcatgtctaataatacagagcgcatcacactccaatgcagaataaaacaaattataaacatgtggcaggaggtaggacgagcaatgtatgcccctcccattgcaggaaacataacatgtagatcaaatattacaggactactattaacacgtgatggaggagataataatactgaaacagagacattcagacctggaggaggagacatgagggacaattggagaagtgaattatataaatacaaggtggtagaaattaaaccattaggagtagcacccactgctgcaaaaaggagagtggtggagagagaaaaaagagcagtaggaataggagctgtgttccttgggttcttgggagcagcaggaagcactatgggcgcagcatcaataacgctgacggtacaggccagacaattattgtctggtatagtgcaacagcaaagtaatttgctgagggctatagaggcgcaacagcatatgttgcaactcacggtctggggcattaagcagctccaggcaagagtcctggctatagagagatacctacaggatcaacagctcctaggactgtggggctgctctggaaaactcatctgcaccactaatgtgctttggaactctagttggagtaataaaactcaaagtgatatttgggataacatgacctggatgcagtgggatagggaaattagtaattacacaaacacaatatacaggttgcttgaagactcgcaaagccagcaggaaagaaatgaaaaagatttactagcattggacaggtggaacaatctgtggaattggtttagcataacaaattggctgtggtatataaaaatattcataatgatagtaggaggcttgataggtttaagaataatttttgctgtgctctctctagtaaatagagttaggcagggatactcacccttgtcattgcagacccttatcccaaacccgaggggacccgacaggctcggaggaatcgaagaagaaggtggagagcaagacagcagcagatccattcgattagtgagcggattcttgacacttgcctgggacgacctacgaagcctgtgcctcttctgctaccaccgattgagagacttcatattaattgtagtgagagcagtggaacttctgggacacagtagtctcaggggactgcagagggggtggggaacccttaagtatttggggagtcttgtgcaatattggggtctagagttaaaaaagagtgctattaatctgcttgatactatagcaatagcagtagctgaaggaacagataggattctagaattcatacaaaacctttgtagaggtatccgcaacgtacctagaagaataagacagggcttcgaagcagctttgcaataa

SEQ ID NO: 64 - DNA, 2538 bp, Artificial Sequence
  Description of Artificial Sequence: Env of clone TV003cE260 of isolate C-98TV003
atgagagtgagggggatactgaggaattggcaacaatggtggatatggggcatcttaggcttttggatgttaatgatttatagtgtattggggaacttgtgggtcacagtctattatggggtacctgtgtggaaagaagcaaaaactactctattctgtgcatcagatgctaaagcatatgagagagaagtgcataatgtctgggctacacatgcctgtgtgcccacagaccccaacccgcaagaaatggtcttgggaaatgtaacagaaaattttaacatgtggaaaaatgatatggtggatcagatgcatgaggatataatcagtttatgggatcaaagcctaaagccatgtgtaaagttgaccccactctgtgtcactttagagtgtaataacgttaatactaccaatgaaatgacaaattgctctttcaatgcaaccacagacgtaagagataagaaacagagagtgtctgcatttttttatagacttgatatagtaccacttaatgagaataacaatgaatcccagaagtatagattaataagttgcaatacctcaaccataacacaagcctgtccaaaggtcacttttgacccaattcctatacattactgtactccagctggttatgcgattctaaagtgtaataataagacattcaatgggacaggaccatgccataatgtcagcacagtacaatgtacacatggaattaagccagtagtatcaactcaactactattgaatggtagcctagcagaagaagagataatcattagatctgaaaatctgacaaacaatgccaaaataataatagtacaccttaatgaatctgtagaaattgtgtgtacaagacccaacaataatacaagaaaaagtataaggataggaccgggacaaacattctatgcaacaaatggcataataggaaacataagacaagcacattgtaacattagtgaagagagatggaacaaaaccttacaacaggtaggaaaaaaattagcagaacacttccctaataaaacaataaagtttgaaccatcctcaggaggggatctagaaattactacacatagctttaattgtggaggagaatttttctattgcaatacatcaggcctgtttaatggtacatacaatcacactacagaaggtaattcaaactcaaccatcacactcccatgcagaataaaacaaattataaacatgtggcgggaggtaggacgagcaatgtatgctcctcccattgcaggaaacataacatgtaaatcaaatatcacaggattactattagtgcgtgatggaggagaaagcaatgactcagacaacaacatcgagatattcagacctggaggaggagatatgaggaacaatcggagaagtgaattatataaatataaagtggtagaaattaagccattgggaatagcacccactggggcaaaaaggagagtggtggagagagaaaaaagagcagtgggactaggagctatgttccttgggttcttgggagcagcaggaagcactatgggcgcggcgtcaataacgctgacggtacaggccagacaactgttgtctggtatagtgcaacagcaaagcaatttgctgaaggctatagaggcgcaacagcatatgttgcaactcacggtctggggcattaagcagctccagacaagagtcctggctatagaaagatacctaaaggatcaacagctcctagggctttggggctgctctggaaaactcatctgcaccactgctgtgccttggaactccagttggagtaataaatctgtaacagatatttgggataacatgacctggatgcagtgggatagggaaattagtaattacacaaacacaatatacaggttgcttgaagactcgcaaacccagcaggaacaaaatgaaaaagatttattagcactggacagttggaataatttgtggaattggtttaacataacaaagtggctgtggtacataaaaatattcataatgatggtaggaggcttgataggcttaagaataatttttgctgtgctctctgtagtaaatagagttaggcaggggtattcaccattatcgtttcagacccttatcccaagcccgaggggacccgacaggctcggaagaatcgaagaagaaggtggagagcaagacagagacagatccgtgcgattagtgaacggattcttagccattgcctgggacgatctacggagcctgtgtcttttcagctaccaccgattgagagacttcatattgattgcaacgagagcggtggaacttctgggacgcagcagtctcaggggattgcagagggggtgggaagcccttaagtatctaggaagtcttgtgcagtattggggtctggaactaaaaaagagtgctgttagtctgcttgataccgtagcaatagtagtagctgaaggaacagataggattatagaattagtacaaagagtttgcagagctatccgcaacatacctacaagaatcagacagggctttgaaacagctttgctataa

SEQ ID NO: 65 - DNA, 2568 bp, Artificial Sequence
  Description of Artificial Sequence: Env of clone TV004cC300 of isolate C-98TV004
atgagagtgagggagataccgaggaattggcaacaatggtggatatggggaatcttaggcttttggatggtaatgatttgtaatgtgatggggaacttgtgggtcacagtctattatggggtacctgtgtggaaagaagcaaaaactactctattctgtgcatcagatgctaaagcatatgagaacgaagtgcataatgtctgggctacacatgcctgtgtacccacagaccccaacccacaagaaatagttttggaaaatgtaacagaaaattttaacatgtggaaaaatgacatggtggatcagatgcatgaggatataatcagtttatgggatcaaagcctacagccatgtgtaaagttgaccccactctgtgtcactttaaattgtacaacggttaccaacagtaccgtcaataacacgcgtggagagatgcgaaattgctctttcaatatgaccacagaagtaagagataagaaacagcaagtgtatgcacttttttataaacttgatgtagtaccacttaatgaaaataatagtgactctagcaactttagtgagtatagattaataaattgtaatacctcagccatgacacaagcctgtccaaaggtcacttttgacccaattcctatacattattgtgctccagctggttatgcgattctaaagtgtaataataagacatttaatgggacaggaccatgcagtaatgtcagcacagtacaatgtacacatggaattaagccagtggtatcaactcaactcctgttaaatggtagcctagcagaaaaagaaataataattagatccgaaaatctgacaaacaatgtcaaaacaataatagtacatcttaatgaatccatagaaattaggtgtacaagacccaacaataatacaagaaaaagtataaggataggaccaggacaaacattctatgcaacaggagaaataataggagacataagacaagcacactgtaccattagtagtcagaactggaatagaactttacaaagggtaagtgaaaaattaaaagaacacttccctaataaaacaataaaatttgaaccatcctcaggaggggacctagaaataacaacacatagctttaattgtagaggagaatttttttattgcaatacatcaggcctatttaatagaacatttaatagtacatacatgcataatagtacaaacaatgactcaatcatcacaatcccatgcagaataaaacaaattataaacatgtggcaggaggtaggaagagcaatgtatgcccctcccgttgcaggaaacataacatgtaaatcaaatatcacaggactactattggtacgggatggaggcgaaaatggcacaaataacacagaggtattcagacctggaggaggaaatatgagggacaattggagaagtgagttatataaatataaagtggtagaaattaaaccattgggagtagcacccaataaggcaaaaaggagagtggtggagagagaaaaaagagcagtgggaataggagctgtgttccttgggttcttgggagcagcaggaagcactatgggcgcggcgtcaatagcgctgacggcacaagccagacaagtattgtctggtatagtgcaacagcaaagcaatttgctgaaggctatagaggcgcagcagcatctgttgcaactcacagtctggggcattaagcagctccagacaagagtcctggctatagaaagatacctaaaggatcaacagctcctagggatttggggctgctctggaaaaatcatctgccccactgctgtgccttggaactccagttggagtaataaatctcaagaagatatttggggaaacatgacctggatgcagtgggatagagaaattagtagttacacaaacacaatatacaatttgcttgaagaatcgcaaagacagcaggagaaaaatgaaaaggatttattagaattggacagttggaactttttgtggagttggtttgacataacaaagtggctgtggtatataaaaatattcataataatagtaggaggcttgataggtttaagaataatttttgctgtgctctctatagtgaatagagttaggcagggatactcacctttgtcgttccagacccttaccccgagcccagggggacccgacaggctcggaagaatcgaagaagaaggtggagagcaagacagagacagatccgtgagattagtgaacggattcttagcacttgcctgggacgacctgcggagcctgtgccttttcagctaccaccgattgagagacttcatattggtgacagcgagagcggtggaacttctgggacgcagcagtctcaggggactacagagggggtgggaagctcttaagtatctgggaagccttgtgcaatattggggtctggagctaaaaaagagtgctactagcctgcttgataccatagcaataacagtagctgaaggaacagataggattatagaaatagtacaaagattctgtagagctatcctccatatacctagaagaataagacagggctttgaagcagctttgctataa

SEQ ID NO: 66 - DNA, 2611 bp, Artificial Sequence
  Description of Artificial Sequence: Env of clone TV006c9.1 of isolate C-98TV006
gtcgacaagagcagaagacagtggcaatgagagtgacggggatactgaggaattacccacaatggtggatatgggtcatcttaggcttttagataatatataatgtgggagggatgtgggtcacagtctattatggggtacctgtgtggaaggaggcaaaaactactctattttgtgcatcagatgctaaagcatatgataaagaagtgcataatgtctgggccacacatgcctgtgtacccacagatcccaacccacaagaattggttttggaaaatgtaacagaaaattttaatatgtggaaaaatgacatggtggatcagatgcatgaagacataatcagtttatgggatgaaagcctaaaaccatgtgtaaagttgaccccactctgtgtcactttaaattgtaaggcaaatgttactgttaatactacgaactttaatgatagcatgattgaacaaatgagaaattgctctttcaatataaccacagaactaagagataagaaaaagcaagtgtatgcacttttttataagcttgatataatacaacttgataatgacaactctagtgacaactctggttatagattaataaattgtaatacctcagccataacacaagcctgtccaaaggtcacttttgacccaattcctatacattattgtgctccagctggatatgcgattctaaagtgtaataataagacattcaatggaacaggaccatgcagtaatgttagcacagtacaatgtacacatggaattaagccagtggtatcaactcaactactgttaaatggtagcctagcagaaggagatataataattagatctcaaaacctgacaaacaatgccaaaataataatagtacatcttaatgaatctgtagaaattgtgtgtacaagacccggcaataatacaagacaaagtataaggataggaccaggacaaacattctatgcaacaggagacataataggagacataaggcaagcacattgtaacattagtgcagggaaatggaatgaaactttaaaaagggtaagtaaaaaattaggagaacactttcctaataaaacaataaaatttgcaccacactcaggaggggacctagaaattacaatgcatagttttaattgtagaggagaatttttttattgtaatacatcaagtctgtttaatagtagttataatacatcagacctgtttaatagtaataatggttcagccatcacactcccatgcagaataaaacaaattgtaaacatgtggcagggggtaggacgagcaatatatgcccctcccattgcaggaaacataacatgtaactcaagtatcacaggactactcttggtacgtgatggaggaaacacaaccaactcaactgagatattcagaccagaaggaggaaatatgagggacaattggagaagtgaatcatataaatacaaagtggtagaaattaagcccttgggaatagcgcccactaatgcaaaaaggagagtggtggagagagaaaaaagagcagtgacactaggagctatgttccttgggttcttgggagcagcaggaagcactatgggcgcagcgtcaataacgctgacggcacaggccagacagttgttgtctggaatagtgcaacagcaaagcaatttgctgagagctatagagacgcaacagcatatgttgcaactcacagtttggggcattaaacagctccaagcaagagtcttggctatagaaagatacctaaaggatcaacagctcctaggaatttggggctgctctggaaaactcatctgcaccactgctgtgccttggaactccagttggagtaataaaactgagaaagatatttgggaaaacatgacctggatgcagtgggatagagaaattagtaattacacagacataatatacaacttacttgaagtctcgcaaatccagcaggaacagaataaaaaagatttattagcattggacagttggaaaattctgtggagttggtttgacatatcaagttggctgtggtacataagaatattcataatgatagtaggaggcttgataggcttgagaataatttctgctgtgctttctatagtgaatagagttaggcagggatactcacctttgtcgtttcagacccttgccccgaacccaagggaactcgacaggctcggaagaatcgaagaagaaggtggagagcaagacagagacagatcgattcgattagtacaaggattcttagcacttgcctgggacgacttgaggagcctgtgccttttcagctaccaccgattgagagacttcatattgattgcagcgaaagcagcggaacttctgggacacaacagtctcaggggactacagagggggtgggaaatccttaagtatctgggaagtcttgctcaatattggggtctagaactcaaaaagagtgctattagtttgcttgataccatagcaatagcagtagctgaaggaacagataggattatagaattaatacaaagaatttggagagctatccgcaacacacctagaagaataagacagggctttgaagcagctttgcaataactctagaaagaaacaagggcgaattc

SEQ ID NO: 67 - DNA, 2614 bp, Artificial Sequence
  Description of Artificial Sequence: Env of clone TV006c9.2 of isolate C-98TV006
gtcgacaagagcagaagacagtggcaatgagagtgagggggatactgaggaattatccacaatggtggatatgggtcatcttaggcttttggataatatataatgtgggagggaacatgtgggtcacagtctattatggggtacctgtgtggaaagatgcaaaaactactctattttgtgcatcagatgctaaagcatatgataaagaagtgcataatgtctgggccacacatgcctgtgtacccacagatcccaacccacaagaattagttttggaaaatgtaacagaaaattttaacatgtggaaaaatgacatggtggatcagatgcatgaagacataatcagtttatgggatgaaagcctaaaaccatgtgtaaagttgaccccactctgtgtcactttaaattgtacagataatgttactgttaatactacgagccttactgttagccctactgttaacataactgaacaaataagaaattgctctttcaatataaccacagaactaagggataagaaaaagcaagtgtatgcacttttttataggcttgacatagtacaatttgataatgacaactctagttataggttaataaattgtaatacctcagccataacacaagcctgtccaaaggtcacttttgacccaattcctatacattattgtgctccagctggatatgcgattctaaagtgtaataataagacattcaatggaacaggaccatgcagtaatgtcagcacagtacaatgtacacatggaattaagccagtggtatcaactcaactactgttaaatggtagcctagcagaaggagatataataattagatctcaaaacctgacaaacaatgccaaaataataatagtacatcttaatgaatctgtagaaattgtgtgtacaagacccggcaataatacaagacaaagtataaggataggaccaggacaaacattctatgcaacaggagacataataggagacataaggcaagcacattgtaacattagtgcagggaaatggaatgaaactttaaaaagggtaagtaaaaaattaggagaacactttcctaataaaacaataaaatttgcaccacactcaggaggggacctagaaattacaatgcatagttttaattgtagaggagaatttttttattgtaatacatcaagtctgtttaatagtagttataatacatcaggcctgtttaatagtaataatggttcaaccatcacactcccatgcagaataaaacaaattgtaaacatgtggcagggggtaggacgagcaatatatgcccctcccattgcaggaaacataacatgtaactcaagtatcacaggactactcttggtacgtgatggaggaaacacaaccaactcaaccgagacattcagaccagaaggaggaaatatgagggacaattggagaagtgaattatataaatataaagtggtagaaattaagcccttgggaatagcgcccactaatgcaaaaaggagagtggtggagagagaaaaaagagcagtgacactaggagctatgttccttgggttcttgggagcagcaggaagcactatgggcgcagcgtcaatagcgctgacggcacaggccagacggttgttgtctggaatagtgcaacagcaaagtaatttgctgaaagctatagaggcgcaacagcatatgttgcaactcacagtttggggcattaaacagctccaagcaagagtcttggctatagaaagatacctaaaggatcaacagctcctaggaatttggggctgctctggaaaactcatctgcaccactgctgtgccttggaactccagttggagtgataaaactgagaaagatatttgggaaaacatgacctggatgcagtgggatagagaaattagtaattacacagacataatatacaatttacttgaagtctcgcaaatccagcaggaacagaatgaaaaagatttattggcattggacagttggaaaagtctgtggaattggtttgacatatcaaaatggctgtggtacataaaaatattcataatgatagtaggaggcttgataggcttgagaataatttttgctgtgctttctatagtgaatagagttaggcagggatactcacctttgtcatttcagacccttatcccgaacccaagggaactcgacaggctcggaagaatcgaagaagaaggtggagagcaagacagagacagatcgattcgattagtacaaggattcttagcacttgcctgggacgacttgaggagcctgtgccttttcagctaccaccgattgagaaacttcatattgattgctgcaagagcagcggaacttctgggacacagcagtctcaggggactacagagggggtgggaaatccttaagtatctgggaagtcttgcacaatattggggtctagaactcaaaaggagtgctattagtctgcttgacatcacagcaattgcagtagctgaaggaacagataggattatagaattaatacaaagaatttggagagctatccgcaacatacctacaaggataagacagggctttgaagcagctttgcaataactctagaaagaaacaagggcgaattc

SEQ ID NO: 68 - DNA, 2574 bp, Artificial Sequence
  Description of Artificial Sequence: Env of clone TV006cE9 of isolate C-98TV006
atgagagtgacggggatactgaggaattatccacaatggtggatatgggtcatcttaggcttttggataatatataatgtgggagggaacatgtgggtcacagtctattatggggtacctgtgtggaaagaggcaaaaactactctattttgtgcatcagatgctaaagcatatgataaagaagtgcataatgtctgggccacacatgcctgtgtacccacagatcccaacccacaagatttggttttggaaaatgtaacagaaaattttaatatgtggaaaaatgacatggtggatcagatgcatgaagacataatcagtttatgggatgaaagcctaaaaccatgtgtaaagttgaccccactctgtgtcactttaaattgtaaagcaaatgttactgttaaaactaatgcaaatgttactgttaatactacgaactttaatgatagcatgattgaacaaatgaggaattgctctttcaatataaccacagaactaagagataagaaaaagcaagtgtatgcacttttttataggcttgatatagtacaatttgacaatgacaactctagttataggttaataaattgtaatacctcagccataacacaagcctgtccaaaggtcacttttgacccaattcctatacattattgtgctccagctggatatgcgattctaaagtgtaataataagacattcaatggaacaggaccatgcagtaatgttggcacagtacaatgtacacatggaattaagccagtggtatcaactcaactactgttaaatggtagcctagcagaaggagatataataattagatctcaaaacctgacaaacaatgccaaaataataatagtacatcttaatgaatctgtagaaattgtgtgtacaagacccggcaataatacaagacaaagtataaggataggaccaggacaaacattctatgcaacaggagacataataggagacataaggcaagcacattgtaacattagtgcagggaaatggaatgaaactttaaaaagggtaagtaaaaaattaggagaacactttcctaataaaacaataaaatttgcaccacactcaggaggggacctagaaattacaatgcatagttttaattgtagaggagaatttttttattgtaatacatcaagtctgtttaatagtagttataatacatcaggcctgtttaatagtaataatggttcaaccatcacactcccatgcagaataaaacaaattgtaaacatgtggcagggggtaggacgagcaatatatgcccctcccattgcaggaaacataacatgtaactcaagtatcacaggactactcttggtacgtgatggaggaaacataaccaactcaaccgagatattcagaccagaaggaggaaatatgagggacaattggagaagtgaattatataaatataaagtggtagaaattaagccattgggaatagcgcccactaatgcaaaaaggagagtggtggagagagaaaaaagagcagtgacactaggagctatgttccttgggttcttgggagcagcaggaagcactatgggcgcagcgtcaataacgctgacggcacaggccagacagttgttgtctggaatagtgcaacagcaaagcaatttggtgagagctatagaggcgcaacagcatatgctgcaactcacagtctggggcattaagcagctccaagcaagagtcttggctatagaaagatacctaaaggatcagcagctcctaggaatttggggctgctctggaaaactcatctgcaccactgctgtgccttggaactccagttggagtagtaaaactgagaaagatatttgggaaaatatgacctggatgcagtgggatagagaaattagtaattacacagacataatatacaacctacttgaagtctcgcaaatccagcaggaacagaatgaaaaagatttattagcattggacagttggaaaaatctgtggaattggtttgacatatcaaaatggctgtggtacataaaaatattcataatgatagtaggaggcttgataggcttgaggataatttttgctgtgctttctatagtgaatagagttaggcagggatactcacctttgtcgtttcagacccttatcccgaacccaagggaactcgacaggctcggaagaatcgaagaagaaggtggagagcaagacagagacagatcgattcgattagtacgaggattcttagcacttgcctgggacgacttgaggagcctgtgccttttcagctaccaccgattgagagacttcatattgattgcagcgagagcagcggaacttctgggacatagcagtctcaggggactacagagggggtgggaaatccttaagtatctgggaagtcttgcacaatattggggtctagaactcaaaaagagtgctattagtctgcttgacatcacagcaattgcagtagctgaaggaacagatagaattatagaattaatacaaagaatttggagagctatccgcaatatacctacaagaataagacagggctttgaaacagctttgctataa

SEQ ID NO: 69 - DNA, 2656 bp, Artificial Sequence
  Description of Artificial Sequence: Env of clone TV007cB104 of isolate C-98TV007
atgagagtgagggggatactgaggaattatcaacaatggtggatatgggccagcttaggcttttggatgttaatgagttataatgtggtggggaacttgtgggtcacagtctattacggggtacctgtgtggaaagaagcaaaaactactctattctgtgcatcagatgctaaaggatatgaaaaagaagtgcataatgtctgggctacacatgcctgtgtacccacagaccccaacccacaagaactggttgtggaaaatgtaacagaaaattttaacatgtggaaaaatgacatggtagatcagatgcatgaggatataatcagtttatgggaccaaagcctaaagccatgtgtaaagttgaccccactctgtgtcactttaagatgtgtaaatgttaatgctaccagtaatgctaccagtagtagtagtgctacctctgataatcccatgaatggagaaataaaaaattgctctttcaatgtaaccacagaaataagggataggaaaaaggaagtgtatgcacttttttataaacctgatgtagtatcacttgacaactctagtacatatagattaataaattgtaatacttcaaccctaacacaagcctgtccaaaagtcacttttgatccaattcctatacattattgtgctccagctggttatgcgattctaaagtgtaataataagacattcaatgggacaggaccatgcactaatgtcagcacagtacaatgtacacatggaattaagccagtagtatcaactcaattactgttaaatggtagcctagcagaaaaagagataataattaaatctaaaaatctgacaaacaatgcccaaacaataatagtacatcttaacgaatctatagaaattaggtgtccaagacccaaccataatacaagacgaagtataaggataggaccaggacaagcattctatgcaacaggagacataataggagatataagacaagcacactgtaacattagcgaaagtaaatggaataaaactttacaaagggtaagtaaaaaattaggagaacacttccctaataaaacaataaaatttgcaccacattcaggaggggacctagaaattacaacacatagctttaattgtagaggggaatttttctattgcaatacatcaaaactgtttaatagtacatacatgcctaatgttacagaaagtaatggtacagaaagtaatgtaacgatgatcacactcccatgcagaataaagcaaattataaacatgtggcaggaggtaggacgagcaatgtatgcccctcccattgcaggcaacataacatgtacatcaaacatcacaggactactattggtacgtgatggaggcacagaggataataccacagagatattcagacctggaggaggagatatgagagataattggagaaatgaactatacaaatataaagtggtagaaattaagccattgggaatagcacccactacagcaaaaaggagagtggcggagagagaaaaaagagcagcaggactaggagctgtactccttggattcttgggagcagcaggaagcactatgggcgcggcgtcaataacgctgacggtacaggccagacaattgttgtctggtatagtgcaacagcaaagcaatttgctgaaagctatagaggcgcaacagcatgtgttgcagctcacggtctggggcattaagcagctccagacaagagtcctggctatagaaagatacctaaaggatcaacagctcctaggaatttggggctgctctggaaaactcatctgcaccactgctgtgccttggaactccagttggagtaatagatctcaaacagatatttggaataacatgacctggatgcagtgggatagagaaattagtaattacacagacacaatatacaagttgcttgaagaatcgcaaaaccagcaggaaaataatgaaaaggatttattagcattgaacagctggcaaaatctgtggagttggtttaacataacaaactggctgtggtatataagaatctttataatgatagtaggaggcttgataggtttaaggataatttttgctgtgatctctatagtgaatagagttaggcagggatactcacctttgttgtctcagacccttaccccaaacccgaggggacccgacaggctcggaagaatcgaagaagaaggtggagagcaagacaaagacagatccattcgattagtgagcggattcttgtcacttgcctgggacgatctgcggagcctgtgcctcttcagctaccaccgattgagagacttaatattgattgtagtgagagcggtggaacttctgggacgcagcagtctcagggggctgcagagggggtgggaagcccttaagtatctgggaggccttgtatagtattggggtctggaactaaaaaagagtgctattagtctgtttgataccatagcaatagcagtagctgaaggaacagataggattatagaattagtacaaggaatttgtagagctatcctcaacatacctagaagaataagacagggctttgaagcagctttgcaataaaatgggtggcaagtggtcaaaaagaatcgaattcccgcggccgccatgcggccgggagcatgcgacgtcgggccca

SEQ ID NO: 70 - DNA, 2412 bp, Artificial Sequence
  Description of Artificial Sequence: Env of clone TV007cB105 of isolate C-98TV007
atgagagtgagggggatactgaggaattatcaacaatggtggatatgggccagcttaggcttttggatgttaatgagttataatgtggtggggaacttgtgggtcacagtctattacggggtacctgtgtggaaagaagcaaaaactactctattctgtgcatcagatgctaaaggatatgaaaaagaagtgcataatgtctgggctacacatgcctgtgtacccacagaccccaacccacaagaactggttgtggaaaatgtaacagaaaattttaacatgtggaaaaatgacatggtagatcagatgcatgaggatataatcagtttatgggaccaaagcctaaagccatgtgtaaagttgaccccactctgtgtcactttaagatgtgtaaatgttaatgctaccagtaatgctaccagtagtagtagtgctacctctgataatcccatgaatggagaaataaaaaattgctctttcaatgtaaccacagaaataagggataggaaaaaggaagtgtatgcacttttttataaacctgatgtagtatcacttgacaactctagtacatatagattaataaattgtaatacttcaaccctaacacaagcctgtccaaaagtcacttttgatccaattcctatacattattgtgctccagctggttatgcgattctaaagtgtaataataagacattcaatgggacaggaccatgcactaatgtcagcacagtacaatgtacacatggaattaagccagtagtatcaactcaattactgttaaatggtagcctagcagaaaaagagataataattaaatctaaaaatctgacaaacaatgcccaaacaataatagtacatcttaacgaatctatagaaattaggtgtccaagacccaaccataatacaagacgaagtataaggataggaccaggacaagcattctatgcaacaggagacataataggagatataagacaagcacactgtaacattagcgaaagtaaatggaataaaactttacaaagggtaagtaaaaaattaggagaacacttccctaataaaacaataaaatttgcaccacattcaggaggggacctagaaattacaacacatagctttaattgtagaggggaatttttctattgcaatacatcaaaactgtttaatagtacatacatgcctaatgttacagaaagtaatggtacagaaagtaatgtaacgatgatcacactcccatgcagaataaagcaaattataaacatgtggcaggaggtaggacgagcaatgtatgcccctcccattgcaggcaacataacatgtacatcaaacatcacaggactactattggtacgtgatggaggcacagaggataataccacagagatattcagacctggaggaggagatatgagagataattggagaaatgaactatacaaatataaagtggtagaaattaagccattgggaatagcacccactacagcaaaaaggagagtggcggagagagaaaaaagagcagcaggactaggagctgtactccttggattcttgggagcagcaggaagcactatgggcgcggcgtcaataacgctgacggtacaggccagacaattgttgtctggtatagtgcaacagcaaagcaatttgctgaaagctatagaggcgcaacagcatgtgttgcagctcacggtctggggcattaagcagctccagacaagagtcctggctatagaaagatacctaaaggatcaacagctcctaggaatttggggctgctctggaaaactcatctgcaccactgctgtgccttggaactccagttggagtaatagatctcaaacagatatttggaataacatgacctggatgcagtgggatagagaaattagtaattacacagacacaatatacaagttgcttgaagaatcgcaaaaccagcaggaaaataatgaaaaggatttattagcattgaacagctggcaaaatctgtggagttggtttaacataacaaactggctgtggtatataagaatctttataatgatagtaggaggcttgataggtttaaggataatttttgctgtgatctctatagtgaatagagttaggcagggatactcacctttgttgtctcagacccttaccccaaacccgaggggacccgacaggctcggaagaatcgaagaagaaggtggagagcaagacaaagacagatccattcgattagtgagcggattcttgtcacttgcctgggacgatctgcggagcctgtgcctcttcagctaccaccgattgagagacttaatattgattgtagtgagagcggtggaacttctgggacgcagcagtctcagggggctgcagagggggtgggaagcccttaagtatctgggaggccttgtatag

SEQ ID NO: 71 - DNA, 2650 bp, Artificial Sequence
  Description of Artificial Sequence: Env of clone TV008c4.3 of isolate C-98TV008
gtcgacaagagcagaagacagtggcaatgagagtgatggggatactgaggaattgtccacaatggtggatatggggcatcttaagcttttggatgttaatgatttgtaatgtaggagggaaattgtgggtcacagtctattatggggtacctgtgtggaaagaagcaaaaactactctattctgtgcatctgatgctaaagcatatgagagggaggtgcataatgtttgggctacacatgcctgtgtacccacagaccccaacccacaagaaatagtattggaaaatgtaacagaaaattttaacatgtggaaaaatgacatggtggatcagatgcatgaggatataattagtttatgggatcaaagcctaaaaccatgtgtaaagttgaccccactctgtgtcactttaaattgtagtgatgttatccccagtaatgttaccaacactacagttacccacaataacatcacggataaagaggaaatgagaaattgtacttttaatataaccacagaaataacagataagaaaagcaaagagtatgcaattttttatagacttgatgtagtaccacttaatgagaaggataacaaatctactgagtgtagattaataaattgtaatacctcaactgtaacacaagcctgtccaaaggtctcttttgaaccaattcctatacattattgtgctccagctggttatgcgattctaaaatgtaataataagacattcaatgggacaggaccatgcaataatgtcagtacaatacaatgtacacatggaatcaagccagtggtatcaactcaactactgctaaatggtagcctagcagaaaaagagataataattagatctgaaaatctgacagacaatgcaaaaacaataatagtacatcttaatgaatccatacgcattatgtgtacaagacccaataataatacaagaaaaagtataagaataggaccaggacaaacattctttgcaacaaacgacataataggagacataagacaagcatattgtaacattagtaaagatgactggaataaaaccttacaaaggatagctgagaaattaggaaaacacttccctaataaaaacataacgtttagaccatcctcaggaggggacctagaaattacaacacatagctttaattgtagaggggaatttttctattgcaatacatcaagactgtttaatcatacatacctgtttaatggtacaggcgtgcctaataataccacaccttctaatgagaccatcatacttccatgcagaataaaacaaattataaacatgtggcaggaggtagggcgagcaatgtatgcccctcccattgcaggaaacatcacatgtacatcaaacatcacaggactactattagtacgtgatggaggcaacagtggcaaaaataccacagaagagatattcagacctgggggaggaaatatgaaggacaattggagaagtgaattatataaatataaagtggtagaaattaagccattaggaatagctcccactgcggcaaaaaggagagtggtggagagagaaaaaagagcagtgggaataggggctgtgttccttgggttcttgggagcagcaggaagcactatgggcgcggcgtcaataacgctgacggtacaggccagacaattgttgtctggtatagtgcaacagcaaagcaatttgctgagggctatagaggcgcaacagcatctgttgcaactcacagtctggggcattaagcagctccagacaagagtcctggctatggaaagatacctacgggatcaacagctcctaggaatttggggctgctctggaaaactcatctgcaccactaatgtgccttggaacgccagttggagtaataaatctctaggagatatttgggataacatgacctggatgcaatgggatagagaaattaataattacacaaacacaatatacaggttgcttgaagaatcgcaaacccagcaggagcaaaatgaaaaagatttattagcattggacaaatggcaaaatctgtggagttggtttaacataacaaattggctgtggtatataaaaatattcataatgatagtaggaggtttgataggtttaagaataatttttgctgtgctatctatagtaaatagagttaggcagggatactcacctttgtcgtttcagacccttatcccagacccgaggggaccagacaggctcagaagaatcgaagaagaaggtggagagcaagacaaagacagatccgtgcgattagtgagcggattcttagcacttgcctgggacgacctgcggagcctgtgccttttcagctaccacctattgagagactttatattgggagtagcgagagtggtggaacttctgggacgcagcagtctcaggaaactacagagggggtgggaagcccttaagtatctgggaagtcttgtgcagtattggggtctggaactagaaaagagtgctattagtctgcttgataccatagcaataacagtagctggggggacagataggattatagaattcctacaacgaatttgtagagctatacgcaacctacctagaagaataagacatggctttgaagcagctttgcaataactctagaaagaaacaagggcgaattc

SEQ ID NO: 72 - DNA, 2641 bp, Artificial Sequence
  Description of Artificial Sequence: Env of clone TV008c4.4 of isolate C-98TV008
gtcgacaagagcagacgacagtggcaatgagagtgatgggaatactgaggaattgtccacaatggtggatatggggcatcttaagcttttggatgttaatgatttgtaatgtaggagggaaattgtgggtcacagtctattatggggtacctgtgtggaaagaagcaaaaactactctattctgtgcatctgatgctaaagcatatgagagggaggtgcataatgtttgggctacacatgcctgtgtacccacagaccccaacccacaagaaatagtattggaaaatgtaacagaaaattttaacatgtggaaaaatgacatggtggatcagatgcatgaggatataattagtttatgggatcaaagcctaaaaccatgtgtaaagttgaccccactctgtgtcactttaaattgtagtgatgttatccccagtaatgttacagttacccacaataacatcatggataaagaggaaatgagaaattgttcttttaatataaccacagaaataacagataagaaaagcaaagagtatgcaattttttatagacttgatgtagtaccacttaatgagaaggataacaaatctactgagtatagattaataaattgtaatacctcaactgtaacacaagcctgtccaaaggtctcttttgaaccaattcctatacattattgtgctccagctggttatgcgattctaaaatgtaataataagacattcaatgggacaggaccatgcaataatgtcagtacaatacaatgtacacatggaatcaagccagtggtatcaactcaactactactaaatggtagcatagcagaagaagggataataattagatctgaaaatctgacagacaatgctaaaacaataatagtacatcttaatgaatccatacgcattgtgtgtacaagacccaataataatacaagaaaaagtataagaataggaccaggacaaacattctttgcaacaaacgacataataggagacataagacaagcatattgtaacattagtaaagatgactggaataaaaccttacaaagggtagctgagaaattaggaaaacacttccctaataaaaacataacgtttagaccatcctcaggaggggacctagagattacaacacatagctttaattgtagaggagaatttttctattgcaacacatcaagactgtttaatcatacatacctgtttaatggtacaggcatgcctaatagtaccacaccttctaatgagaccatcatacttccatgcagaataaaacaaattataaacatgtggcaggaggtagggcgagcaatgtatgcccctcccactgcaggaaacatcacatgtacatcaaacatcacaggactactattagtacgtgatggaggcaacagtggcaacaataccacagaagagatattcagacctggaggaggaaatatgagggacaattggagaagtgaattatataaatataaagtggtagaaattaagccattaggaatagctcccactgcggcaaaaaggagagtggtggagagagaaaaaagagcagtgggaataggagctgtgttccttgggttcttgggagcagcaggaagcactatgggcgcggcgtcaataacgctgacggtacaggccagacaattgttgtctggtatagtgcaacagcaaagcaatttgctgagggccatagaggcgcaacaacatctgttgcaactcacggtctggggcattaagcagctccagacaagagtcctggctatggaaagatacctaaaggatcaacagctcctaggaatttggggctgctctggaaaactcatctgcaccactaatgtaccttggaacaccagttggagtaataaatctctaagtgatatttgggataacatgacctggatacagtgggatagagaaattaataattacacaagcacaatctacaggttgcttgaagaatcgcaaacccagcaggaacaaaatgaaaaagatttattagcattggacaaatggcaaaatctgtggagttggtttaacataacaaattggctgtggtatataaaaatattcataatgatagtaggaggcttgataggtttaagaataatttttgctgtgctatctatagtaaatagagttaggcagggatactcacctttgtcgtttcagacccttatcccagacccgaggggaccagacaggctcagaagaatcgaagaagaaggtggagagcaagacaaagacagatccgtgcgattagtgagcggattcttagcacttgcctgggacgacctgcggtgcctgtgccttttcagctaccacctattgagagactttatattgggagtagcgagagtggtggaacttctgggacgcagcagtctcaggaaactacagagggggtgggaagcccttaagtatctgggaagtcttgtgcagtattggggtctggaactaaaaaagagtgctattagtctgcttgataccatagcaataacagtagctggggggacagataggattatagaattcctacaacgaatttgtagagctatacgcaacctacctagaagaataagacagggctttgaagcagctttgcaataactctagaaagaaacaagggcgaattc

SEQ ID NO: 73 - DNA, 2541 bp, Artificial Sequence
  Description of Artificial Sequence: Env of clone TV010cD7 of isolate C-98TV010
atgagagtgatggggatactgaggaattgtcaacaatggtggatgtggggcatcttaggcttttggatgatttgtaatgtggtggggaatttgtgggtcacagtctattatggggtacctgtgtggaaagaagcaaaaactactctattctgtgcatcagatgctaaaggatatgagaaagaagtgcataatgtctgggctacacatgcctgtgtacccacagaccccaacccacaagaattagttttagaaaatgtaacagaaaattttaacatgtggaaaaatgacatggtggatcagatgcatgaggatataatcagtttatgggatcaaagcctaaaagccatgtgtaaagttgaccccactttgtgtcactttaagttgtacaaatgctactacctacatagcaccataggggacgaaataaaaaattgctctttcaatacaaccacagtactaaaagataagacacagaaagtgcatgcacttttttataaacttgatgtagtaccacttaatgggagtaactctagtgagtatagattaataaattgtaatacctcaaccataacacaagcctgtccaaaggtctcttttgacccaattcctatacattattgtgctccagctggttatgcgattctaaagtgtaataacaagacattcaatgggacaggaccatgccaaaatgtcagcacagtacaatgtacacatggaattaaaccagtggtatcaacgcaactactgataaatggtagcctagcagaaggagagataatgattagatctgaaaatttgacaaacaatgctaaaacaataatagtgcattttaatcaatctatagaaattgtgtgtacaagacccaacaataatacaaggaaaagtgtaaggataggaccaggacaaacattctatgcaacaggagacataataggagacataagagaagcacattgtaacattagcaaagaaaagtggaataacactttacaagaagtaagtaaaaaattaaaggaacactaccctaataaaacaataacatttaaaccacactcaggaggggacccagaaattacaacacatagctttatttgtagtggagaatttttctattgtaatacatcaggcctgtttaatggtacatacatgcccaatggtacagacaagtctaatgatacatcacccatcacactcccatgcagaataaaacaaattataaacatgtggcagggggtaggacgagcaatgtatgccccgcccattgcaggaaacataacatgtaaatcaaatatcacaggactactattgacacgtgatggaggagaaaataatagaactaatgagacattcagacctggaggaggagatatgagggacaattggagaagtgaattatataaatataaagtggtagaaattaaaccattgggaatagcacccactactgcaaaaaggagagtggtggagagagaaaaaagagcagtgggaataggagctatgttccttgggttcttgggaatggcaggaagcactatgggcgcggcgtcaataacgctgacggtacaggccagacaattgttgtctggtatagtgcaacagcaaagcaaattgctgagggccatagaggcgcaacagcatatgttgcaactcacggtctggggcattaagcagctccaggcaagagtcctggctataaaaagatacctaaaggatcaacagctcctaggactgtggggctgctctggaaaactcatctgcaccactgctgtgccttggaactccagttggagtaataataagtctcaaacagaaatttgggataacatgacctggatgcagtgggatagagaaattagtaattactcaaacacaatatacaggttgcttgaagaatcgcaaaaccagcaggaaaagaatgaaaaggatttattagcattggacagttggaataatctgtggaattggtttagtataacaaagtggttgtggtatataagaatattcataataatagtaggaggcttgataggtttaagaataatttttgcagtgatctctatagcgaatagagttaggcagggatactcacctctgtcgttgcagacccttatcccagacccgaggggacccgacaggcccggaagaatcgaagaagaaggtggagagcaagacagagacagatccataagattagtgagcggattcttagcacttgcctgggacgatctgaggagcctgtgccttttctgctaccaccgattgagagacttcatattgattgcagcgagagtggtggaacttctgggacgcagcagtctcaggggactacagagggggtgggaagcccttaagtatctgggaagtcttgtgcagtattggggtctagagctaaaaaagagtgctattagtctgcttgataccatagcaatagcaacagctgaaggaacagataggattatagaattaatacaaggaattggtagagctatctacaatatacccagaagaataagacagggctttgaagcagctttgcaataa

SEQ ID NO: 74 - DNA, 2591 bp, Artificial Sequence
  Description of Artificial Sequence: Env of clone TV012c2.1 of isolate C-98TV012
gtcgacaagagcagaagacagtggcaatgagagtgatggggagcaggaggaattatcaacaatggtggatatggggaatcttaggcttttggatgctaatggttggtaatgtaatggggaacttgtgggtcacagtctattatggggtacctgtgtggaaagaagcaaaagctacgctattttgtgcatctgatgcaaaagcatatgagaaagaagtgcataatgtctgggctacacatgcctgtgtacccacagaccccgacccacaagaaatagttttggagaatgtaacagaaaattttaacatgtggaaaaataacatggtggaccagatgcatgaggatataatcagcttatgggatcaaagcctaaagccatgtgtaaagttgaccccactttgtgtcactttaaactgtagcaataatgttaaaaatgctaccaacagtatgaaggaaatgaaaaattgcactttcaatataaccacagaactaagagataagagaaagcaagaatatgcacttttttataaacttgatatagtaccacttgaggagaattccagtaagtatagattaataaattgtaatacctcagccataacccaagcctgtccaaaggtctcttttgacccaattcctatacattattgtgctccagctggttatgcgattctaaagtgtaataataagacattcaatggaacaggaccatgcaataatgtcagcactgtacagtgtacacatggaatcaagccagtagtatcaactcaactactgttaaatggtagtctagcagaagaagaaatagtaattagatctgaaaatatgacaaacaatgccaaaataataatagtacatcttaatgaatctgtagaaattacgtgtacaaggcccaacaataatacaaggaaaagtatgaggataggaccaggacaaacattctatgcaacaggagacataataggagatataagacaagcacactgtaacattagtgaaaagcaatgggatcagactttatacagggtaagtgaaaaattaaaagaacacttccctaataaaacaataaagtttaactcatcctcaggaggggacttagaaattacaacacatagctttaattgtggaggagagtttttctattgcaatacatcagcactgtttaatggcatatacagtaatggcacaaacagtacaaatacaacagtcatcacactccaatacagaataagacaaattataaacatgtggcagggggtaggacgagcaatgtatgcccctcccattgcaggaaacataacatgcagatcaaacatcacaggactaatattgacacgtgatggaggtgaagggaatggcacgaatacggatgagatatttagacctgcaggaggagatatgagggacaattggagaagtgaattatacaaatataaagtggtagaaattcagccattaggggtagcacccactaaggcaaaaaggagagtggtggagagagaaaaaagagcagctttgggagctgtgttccttgggttcttgggagcagcaggaagcactatgggcgcggcatcaataacgctgacggtacaggccagacaactgttgtctggtatagtgcaacagcaaagcaatttgctgagagctgtagaggcgcaacagcatatgttgcaactcacggtctggggcattaagcagctccagacaagagtcctggctatagaaagatacctaaaggatcaacagctcctagggatttggggctgctctggaaaactcatctgcaccactgccgtgccttggaacaatagttggagtaataaatctcaagattatatttggggaaacatgacctggatgcaatgggataaagaaattaacaattacacagacacaatatacaggttgcttggggacgcgcaaaaccagcaggaggaaaatgaaaaggagttactagaattggacaggtggggaaatctgtggaattggtttgacatgacaagctggctgtggtatataaaaatattcataatggtaataggaggcttgataggtttaagaataatttttgccgtgctttctatagtaaatagagttaggcagggatactcacctttgtcatttcagacccttgcccaaaacccgaggggacccgacaggctcggaagaaccgaagaagaaggtggagagcaagacagagacagatccataagattagtgagcggattcttagcacttgcctgggaggacttgaggaacctgtgcatcttcctctaccaccgattgagggacttcgtattggtgacagcgagagcagtggaacttctgggacgcagcagtctcaggggacttcagagggggtgggaaatccttaagtatttggggagtcttgtgcagtattggggtctagagctaaaaaagagtgctgttagtctgcttgatagcttagcaatagcagtagctgagggaacagatagaattatagaattcttacaaggaattggtagagctatctacaatatacctagaagaataagacagggctttgaagcagctttgcaataactctagaaagaaacaagggcgaattcc

SEQ ID NO: 75 - DNA, 2591 bp, Artificial Sequence; identical to SEQ ID NO: 74
  Description of Artificial Sequence: Env of clone TV012c2.2 of isolate C-98TV012

SEQ ID NO: 76 - DNA, 2583 bp, Artificial Sequence
  Description of Artificial Sequence: Env of clone TV013cB20 of isolate C-98TV013
atgaaagtgagggagatacagaggaattggccacaatggtggatatggggcatcttaggcttttggatgataataatttgtagtggggtggggaacttgtgggtcacagtctattatggggtacctgtgtggaaagaagcaacaactactctattctgtgcatcagatgctaaagcatatgagaaagaagtgcataatgtctgggctacacatgcctgtgtacccacagaccccgacccacaagaaatagttttggaaaatgtaacagaacattttaacatgtggaaaaatgacatggtggatcagatgcatgaggatataatcagtttatgggatcaaagtctaaaaccatgtgtaaagttgaccccactctgtgtcactttaaattgtacaaatgctatcaatacaaatgctaccagtacaactactaccagtgcaactgctaccagtacaattgctaccagtacctatgataataatggagaaataaaaaattgctctttcaatacgaccacagaaataagagataagaaacagaacacatatgcacttttttatagatctgatatagtaccacttaataataggagtgagtatatattaataaattgtaatacctcaaccataacacaagcctgtccaaaggtctcttttgacccaattcctatacattattgtgctcccgctggtttcgcgattctaaagtgtaataataagacattcaatgggacaggaccatgccaaaatgtcagcacagtacaatgtacacatggaattaaaccagtggtatcaactcaactactgttgaatggtagcctggcagaagaggatataagaattagatctgaaaatctggaaaacaatatcaaaacaatagtagtccaccttaatcaatctgtaaaaattgtgtgtacaagacccaacaataatacaagaagaagtataaggataggaccaggacaagcattctatacaaatgacataataggagacataagacaagcacattgtaacattagtagagctgagtggaacaacactctagctaaggtaaaggaaaaattagaaaaactctacaataaaacaatagtatttgaaccacactcaggaggggatctagaaattacaacacatagctttaattgtagaggagaattcttctattgcaatacaacaaaactgtttaatataacagaagtgcagaggaatgtaaatgatacaaatggcacactcacactcccatgcaggataaaacaatttataaacatgtggcaggaggtaggacgggcaatgtatgcccctcccattgcaggaaacataacatgtagatcaaatatcacaggactactattgacacgtgatggaggaaacataacgaacgagacagagacatctagacctggaggaggaaatatgaaagacaattggagaagtgaattatataaatataaagtggtagaaattaagccattgggaatagcacccactgaggcaaaaaggagagtggtggagagagaaaaaagagcagtgggaataggagctgtgttccttgggttcttgggagcagcaggaagcactatgggcgcggcgtcaataacgctgacggtacaggccagacaactgttgtctggtatagtgcaacagcaaagcaatttgctgagagctatagaggcgcaacagcatctgttgcaactcacagtctggggcattaagcagctccaggcaagagtcttggctatagaaagatacctaaaggatcaacagctcctagggctttggggctgctctggaaaactcatctgcaccactgctgtgccttggaactccagttggagtaataaatctcaaacagatatttgggacaacatgacctggatgcagtgggatagaaaaattagtaattacacaggcataatatacaggttgcttgaggactcgcaaacccagcaggaacaaaatgaaaaagatttattagcattggacagttggaaaaatctgtggacttggtttgacatatcaaagtggttgtggtatataagaatattcatcatgatggtaggaggcttgataggtttaagaataattttaggtgtgctctctatagtgaaaagagttaggcagggatactcacctttgtcgtttcagacccttatcccaaacccgagggaacccgacaggctcagagggatcgaagaagaaggtggagagcaagacaaagacagatcaattcgattagtgagcggattcttagcacttgcctgggacgacctgcggagcctgtgcctcttcagctaccaccaattgagagacttcatattgattgtggcgagagcagtggaacttctgggacagagcagtctcaggggactacagagggggtgggaagcccttaagtatctgggaaatcttgtgcagtattggggtctggaactaaaaaagagtgctattagtctgcttgataccatagcaatagcagtagctgaaggaacagataggattattgaaataatacagagaatttgtagagctatccgcaacatacctagaagaataagacagggctttgaagcagctttgctataa

SEQ ID NO: 77 - DNA, 2583 bp, Artificial Sequence
  Description of Artificial Sequence: Env of clone TV013cH17 of isolate C-98TV013
atgaaagtgagggagatacagaggaattggccacaatggtggatatggggcatcttaggcctttggatgataataatttgtagtggggtggggaacttgtgggtcacagtctattatggggtacctgtgtggaaagaagcaacaactactctattctgtgcatcagatgctaaagcatatgagaaagaagtgcataatgtctgggctacacatgcctgtgtacccacagaccccgacccacaagaaatagttttggaaaatgtaacagaacattttaacatgtggaaaaatgacatggtggatcagatgcatgaggatataatcagtttatgggatcaaagtctaaaaccatgtgtaaagttgaccccactctgcgtcactttaaattgtacaaatgctatcaatacaaatgctaccagtacaactactaccagtgcaactgctaccagtacaattgctaccagtacctatgataataatggagaaataaaaaattgctctttcaatacgaccacagaaataagagataagaaacagaacacatatgcacttttttatagatctgatatagtaccacttaataataggagtgagtatatattaataaattgtaatacctcaaccataacacaagcctgtccaaaggtctcttttgacccaattcctatacattattgtgctcccgctggtttcgcgattctaaagtgtaataataagacattcaatgggacaggaccatgccaaaatgtcagcacagtacaatgtacacatggaattaaaccagtggtatcaactcaactactgttgaatggtagcctagcagaagaggatataagaattagatctgaaagtctggaaaacaatatcaaaacaataatagtccaccttgatcaatctgtaaaaattgtgtgtacaagacccaacaataatacaagaagaagtataaggataggaccaggacaagcattctatacaaatgacataataggagacataagacaagcacattgtaacattagtagagctgagtggaacaacactctagctaaggtaaaggaaaaattagaaaaactctacaataaaacaatagtacttgaaccacactcaggaggggatctagaaattacaacacatagctttaattgtagaggagaattcttctattgcaatacaacaaaactgtttaatataacagaagtgcagaggaatgtaaatgatacaaatggcacactcacactcccatgcaggataaaacaatttataaacatgtggcaggaggtaggacgggcaatgtatgcccctcccattgcaggaaacataacatgtagatcaaatatcacaggactactattgacacgtgatggaggaaacataacgaacgagacagagacatttagacctggaggaggaaatatgaaagacaattggagaagtgaattatataaatataaagtggtagaaattaggccattgggaatagcacccactgaggcaaaaaggagagtggtggagagagaaaaaagagcagtgggaataggagctgtgttccttgggttcttgggagcagcaggaagcactatgggcgcggcgtcaataacgctgacggtacaggccagacaactgttgtctggtatagtgcaacagcaaagcaatttgctgagagctatagaggcgcaacagcatctgttgcaactcacagtctggggcattaagcagctccaggcaagagtcttggctatagaaagatacctaaaggatcaacagctcctagggctttggggctgctctggaaaactcatctgcaccactgctgtgccttggaactccagttggagtaataaatctcaaacagatatttgggataacatgacctggatgcagtgggatagagaaatcagtaattacacaggcataatatacaggttgcttgaagactcgcaaacccagcaggaacaaaatgaaaaagatttattagcattggacagttggaaagatctgtggacttggtttgacatatcaaagtggttgtggtatataagaatattcatcatgatagtaggaggcttgataggtttaagaataattttaggtgtgctctctatagtgaaaagagttaggcagggatactcacctttgtcgtttcagacccttatcccaaacccgagggaacccgacaggctcagaggaatcgaagaagaaggtggagagcaagacaaagacagatcaattcgattagtgagcggattcttagcacttgcctgggacgacctgcggagcctgcgcctcttcagctaccaccaattgagagacttcatattgattgtggcgagagcagtggaacttctgggacagagcagtctcaggggactacagagggggtgggaagcccttaagtatctgggaaatcttgtgcagtattggggtctggaactaaaaaagagtgctattagtctgcttgataccatagcaatagcagtagctgaaggaacagataggattgttgaaataatacagagaatttgtagagctatccgcaacatacctagaagaataagacagggctttgaagcagctttgctataa

SEQ ID NO: 78 - DNA, 2628 bp, Artificial Sequence
  Description of Artificial Sequence: Env of clone TV014c6.3 of isolate C-98TV014
gtcgacaagagcagaagacagtggcaaggagtgagggggatacagaggaattggcaacaatggtggatatggggcatcttaggcttttggatgttaatgatttgtaatgtgttgggaaacttgtgggtcacagtgtattatggggtacctgtgtggaaagaagcaataactactctattctgtgcatcaaatgctaaagcatatgagagggaggtgcataatgtctgggctacacatgcctgtgtacccacagaccccaacccacaagaaatagttttgggaaatgtaacagaaaattttaatatgtggaaaaatgacatggtggatcaaatgcatgaggatataatcagtttatgggatcaaagcctaaagccatgtgtaaagttgaccccactctgtgtcactttagaatgtacaggggttaaggctaccaataatagtagtgccaccaatagtagtaatgttaccaacaatgatgaaataaaaaattgctctttcaatgcaaccacagaaataaaagacaagaagcacaaagagtatgcacttttttataggctcgatatagtaccacttaataatggcaaccctagtgagggcaattctagtgagaagtatagattaataaattgtaatacctcaaccttaacacaagcctgtccaaaggtctcttttgacccaattcctatacattattgcactccagctggttatgcgattctaaagtgtaataataagacattcaatgggacaggaccatgccataatgtcagtacagtacaatgtacacatggaattaaaccagtggtatcaactcaactactgttaaatggtagcttagcagaagaagagataataattagatctgaaaatctgacaaacaatgctaaaataataatagtacagcttaataaatctgtagaaattgtgtgcacaagacccggcaataatacaagaaaaagtgtaaggataggaccaggacaaacattctatgcaacaggtgacataataggagacataagacaagcacattgtaacattactgaagataagtggaatgaaactttacaatgggtaggtaaaaaattaggagagctcttccctaataaaacaatagaatttaagccatcctcaggaggggacctagaaattacaacacatagctttaattgtagaggagaatttttctattgcaatacatcacaactatttaatagtacatacaattctacacaaatgcataatgatacaggaagtaattcaaccatcacactcccatgcaaaataaagcaaattataaacatgtggcagggggtaggacgggcaatgtatgcccctcccattgcaggaaacataacatgtaaatcaaatattacaggaatactattagtacgtgatggaggcaacacaaatgacacaaatggcacaggaatattcagacctggaggaggagatatgaaggacaattggagaagtgaattatataaatataaagtggtagaaattaagccattgggaatagcacccactgaagcaaaaaggagagtggtggagagagaaaaaggagcagtaggaataggagctgtactccttgggttcttgggagcagcaggaagcactatgggcgcagcgtcaataacgctgacggtacaggccaggcaattgttgtctggcatagtgcaacagcaaagcaatttgctgagagctatagaggcgcaacagcatatgttgcaactcacggtctggggcattaagcagctccaggcaagagtcctggctatagaaagatacctacaggatcaacagctcctaggactttggggctgctctggaaaactcatctgcaccactactgtgccttggaactcaagttggagtaataaatctctaactgatatttgggataacatgacatggatgcagtgggatagagaaattaataattacacaaccacaatataccagttgcttgaaaaatcgcaaatccagcaggaacaaaatgagaaagatttattagcattggacaagtggcaaaatctgtggaattggtttagcataacacagtggctatggtatataaaaatattcatcatgatagtaggaggcttgataggtttaagaataatttttgctgtgctatctatagtaaacagagttaggcagggatactcacctctgtcatttcagacccttaccccaaacccgaggggacccgacaggctcggaagaatcgaagaagaaggtggagagcaagacagagagagatccattcgattagtgagcggattcttctcacttgcttgggacgatctgcggaacctgtgcctcttcagctaccaccgattgagagacttcatattgattgcgacaagagtggtggaacttctggggcgcagggggtgggaaacccttaaatatctaggaagtcttgggcagtattggggtctggaactaaaaaagagtgctattagtctgcttgatgccatagcaatagcagtagctgagggaacagataggattatagaattcatacaaagaatttgtagggctatccgcaacacacctagaagaataagacatggcttttaagcagctttgcaataactctagaaagaaacaagggcgaattcc

SEQ ID NO: 79 - DNA, 2630 bp, Artificial Sequence
  Description of Artificial Sequence: Env of clone TV014c6.4 of isolate C-98TV014
gtcgacaagagcagaagacagtggcaatgagagtgagggggatacagaggaattggcaacaatggtggatatggggcatcctaggcttttggatgttaatgatttgtaatgtgttgggaaacttgtgggtcacagtgtattatggggtacctgtgtggaaagaagcaaaaactactctattctgtgcatcagatgctaaagcatatgagagggaggtgcataatgtctgggctacgcatgcctgtgtacccacagaccccaacccacaagaaatagttttgggaaatgtaacagaaaattttaatatgtggaaaaatgacatggtggatcaaatgcatgaggatataatcagtttatgggatcaaagcctaaagccatgtgtaaagttgaccccactctgtgtcactttagaatgtacaggggttaaggctaccaataatagtagtgccaccaatagtagtaatgttaccaacaaagatgaaataaaaaattgctctttcaatgcaaccacagaaataaaagacaagaagcacaaagagtatgcacttttttataggctcgatatagtaccacttaataatggcaaccctagtgagggcaattctagtgagaagtatagattaacaaattgtaatacctcaaccttaacacaagcctgtccaaaggtctcttttgacccaattcctatacattattgcactccagctggttatgcgattctaaagtgtaataataagacattcaatgggacaggaccatgccataatgtcagtacagtacaatgtacacatggaattaaaccagtggtatcaactcaactactgttaaatggtagcttagcagaagaagagataataattagatctgaaaatctgacaaacaatgctaaaataataatagtacagcttaataaatctgtagaaattgtgtgcacaagacccggcaataatacaagaaaaagtgtaaggataggaccaggacaaacattctatgcaacaggtgacataataggagacataagacaagcacattgtaacattactgaagataaatggaatgaaactttacaatgggtaggtaaaaaattaggagagctcttccctaataaaacaatagaatttaagccatcctcaggaggggacctagaaattacaacacatagctttaattgtagaggagagtttttctattgcaatacatcacaactatttaatagtacatacaattctacacaaatgcataatgatacaggaagtaattcaaccatcacactcccatgcaaaataaagcaaattataaacatgtggcagggggtaggacgggcaatgtatgcccctcccattgcaggaaacataacatgtaaatcaaatattacaggaatactattagtacgtgatggaggcaacacaaatgacacaaatggcacagaaatattcagacctggaggaggagatatgaaggacaattggagaagtgaattatataaatataaagtggtagaaattaagccattgggaatagcacccactgaagcaaaaaggagagtggtggagagagaaaaaagagcagtaggaataggagctgtactccttgggttcttgggagcagcaggaagcactatgggcgcagcgtcaataacgctgacggtacaagccaggcaattgttgtctggcatagtgcaacagcaaagcaatttgctgagagctatagaggcgcaacagtatatgttgcaactcacggtctggggcattaagcagctccaggcaagagtcctggctatagaaagatacctacaggatcaacagctcctaggactttggggctgctctggaaaactcatctgcaccactactgtgccttggaactcaagttggagtaataaatctctaactgatatttgggataacatgacatggatgcagtgggatagagaaattaataattacacaaccacaatataccagttgcttgaaaaatcgcaaatccagcaggaacaaaatgagaaagatttattagcattggacaagtggcaaaatctgtggaattggtttagcataacacagtggctatggtatataaaaatattcatcatgatagtaggaggcttgataggtttaagaataatttttgctgtgctatctatagtaaacagagttaggcagggatactcacctctgtcatttcagacccttaccccaaacccgaggggacccgacaggctcggaagaatcgaagaagaaggtggagagcaagacagagagagatccattcgattagtgagcggattcttctcacttgcttgggacgatctgcggaacctgtgcctcttcagctaccaccgattgagagacttcatattgattgtgacgagagtggtggaacttctggggcgcagggggtgggaaacccttaaatatctaggaagtcttgggcagtattggggtctggaactaaaaaggagtgctattagtctgcttgatgccatagcaatagcagtagttgagggaacagataggattatagaattcatacaaagaatttgtagggctatccgtaacacacctagaagaataagacagggctttgaagcagctttgcaataactctagaaagaaacaagggcgaattcc

SEQ ID NO: 80 - DNA, 2580 bp, Artificial Sequence
  Description of Artificial Sequence: Env of clone TV018cF1027 of isolate C-98TV018
atgagagtgatggggatcaagaggaattgtcaacaatggtggatatggggcatcttaggcttttgggtgcttatgatttgtaatgtaatggggaacttgtgggtcacagtctattatggggtacctgtgtggagagaagcaaaaactacactattctgggcatcagatgctaaagcatatgagaaagaagtgcataatgtttgggctacacatgcctgtgtacccacagaccccaacccacaagaaatagttttggaaaatgtaacagaaaattttaacatgtgggaaaataacatggtagaccagatgcatgaggatataatcagtttatgggatcaaagtctaaaaccatgtgtaaagttgaccccactctgtgtcactttaaattgtagaaatgtaacggttactactaacaatgataataatgttacttacaataatagcatacctgaagaaataaaaaattgctctttcaatataaccacagaaataagagacaagaaaaagatagaatatgcacttttttatagacttggtatagtaccgcttaaggagaacaaacttaattccagtgagtatagattaataaattgtaatacctcagccataacacaagcctgtccaaaggtctcttttgacccaattcctatacattattgtgctccagctggttatgcgatactaaagtgtaataataagacattcaatggaacaggaccatgcaataatgtcagcactgtacagtgtacacatggaattaagccagtggtatcaactcaactactgttaaatggtagtctagcagaggaagagataataattagatctaaaaatatgacaaacaatgtcaaaacaataatagtacatctgaatgaatctgtagaaattgtgtgtacaaggcccaacaataatacaagaagaagtatgaggataagaccaggacaaacattctatgcaacaggagaaataataggagacataagacaagcatattgtaaaattagtgaagatcaatggaataaaactttacgcagggtaagtgaaaaattaagagaacacttccctgataaaacaataaaatttgaaccaccctcaggaggagacttagaaattacaacacatagctttaattgtagaggagaatttttctattgcaatacatcagaactgtttaatagtacatacatgcctaatggtacagaaagtaatacaagcaaaaccatcatactcccatgcagaataaaacaaattataaatatgtggcagggggtaggacgagcaatgtatgcccctcccattgcaggaaacataacatgtcaatcaaatatcacaggaatactattgacccgtgatggaggagaagagtcaaagtcaaatggaacagagatattcaggcctgcaggaggggatatgaaggacaattggagaagtgaattatatagatataaagtggtagaaattaaaccattaggagtagcacccactgaggcaaaaaggagagtggtggagagagaaaaaagagcagtgggaataggagctgtgttccttgggttcttgggagcagcaggaagcactatgggcgcggcgtcaataacgctgacggtacaggccagacaaccgttttctggtatagtgcaacagcaaagcaatttgctgagggctatagaggcgcaacagcatatgttgcaactcacagtctggggcattaagcagctccagacaagagtcctggctgtagaaagatacctaaaggatcaacagctcctagggctttggggctgctctggaaaactcatctgcaccactgccgtgccttggaactccagttggagtaataagtctcaaacagatatttgggataacatgacatggatgcagtgggatagagagatcagtaactacacagaaacaatatacaagttgcttgaagactcgcaaaaccagcaggaacaaaatgaaaaggatttactagcattggacagttggaaaaatctgtggaattggtttgatataacaaaatggctgtggtatataaaaatattcataatgatagtaggaggcttgataggtttaagaataatttttgctgtgctatctataataaatagagttaggcagggatactcacctttgtcattacagacccttaccccaaacccgaggggaccagacaggctcggaagaatcgaagaagaaggtggagagcaagacagagacagatccgtgagattagtgaacggattcttagcacttgtctgggacgacctgcggagcctgtgcctcttcagctaccaccaattgagagacttaatattgattgtagcgagagcagtggaagttctgggacgcaacagtctcaggggactacagacggggtgggaagctcttaagtatctgggaaaccttgtgctgtattggggtctggagctgaaaaggagcgctattagtctgttggatacaacagcaatagtagtagctgaaggaacagataggatttttgaagcaatatgcagaatttgtagagctatccgtaacatacctagaagaataagacggggctttgaagcagctttgctataa

SEQ ID NO: 81 - DNA, 2717 bp, Artificial Sequence
  Description of Artificial Sequence: Env of clone TV019c5 of isolate C-98TV019
ggatccactagtaacggccgccagtgtgctggaattcgcccttccacgcgtcgacaagagcagaagacagtggcaatgagagtgcaggggatactgaggaattgtcaacaatggtggacatggggcatcttaggcttttggataataatgacttgtaatgtggtgggaaacttgtgggtcacagtttattatggggtacctgtgtggaaagaagcaaaaactactctattctgtgcatcagatgctaaagcatatgagaaagaagtgcataatgtttgggctacacatgcctgtgtacccacagaccccaacccacaagaaatagttttggaaaatgtaacagaaaattttaatatgtggaaaaatgatatggtggatcagatgcatgaggatgtaatcagtttatgggaccaaagcctaaagccatgtgtaaagttgaccccactttgtgtcactttaaattgtacagatgttgataaaaatagtactgaaatgtataggaaaaccacaaatgataatggtaatgataccatagatagagaaatgaaaaattgctctttcaatgcaaccacagacatacaagataagaaaacgggagtgtatgcacttttttatcgactggatatagtaccactcaatgatactaacaactctagggagtatagattaataaattgtaatacctcaaccatgacacaagcctgtccaaaggtctcttttgatccaattcctatacattattgtactccagctggttatgcgattctaaagtgtaataataagacattcagtgggacgggaccatgcaataatgtcagcacagtacaatgtacacatggaattaagccagtggtatcaactcaactactgttaaatggtagcctagcagaaaaagagataataattagatctaaaaatctgacagacaatgccaaaacaataatagtacatcttaatgaatctatagcaattatgtgtacaagacctggcaataatacaagaaaaagtataaggataggaccaggacaagcattctttgcaacaggagcaataataggagatataagaaaagcatattgtaacattagcgaaggtgaatggaatagaactttacaaagggtaggtagaaaattagcagaacacttccctggtaaaagaataagatttgcaccaccttcaggaggggacctggaaattacaacacatagctttaattgtggaggagaatttttctattgcaatacaacacaactgtttaataggacatacaatacaacacaactgtttaatggtacatacagctctaacgatacagaaagtaatttcacactcccatgcagaataaaacaaattataaacatgtggcaggaggtaggacgagcaatgtatgctcctcctataaaaggaaacataacatgtaactcaaatatcacaggattactgttggtgcgtgatggaggagaagacaataacacagaaaatgacacagagaccttcagacctggaggaggagatatgagggacaattggagaagtgaattatacaaatataaagtggtagaaattaagccattgggaatagcacctactggggcaaaaaggagagtggtggagagagaaaaaagagcagtgggaataggagctgtgttccttgggttcttgggagcagcaggaagcactatgggcgcggcgtcaataacgctgacggtacaggccagacaattattgtctggtatagtgcaacagcaaagcaatttgctgagggccatagaggcgcaacaacatatgttgcaactcacagtctggggcattaaacagctccagacaagagtattggccatcgaaagatacctaaaggatcaacagctcctaggaatttggggctgctctggaaaactcatctgcaccactgctgtgccttggaactccagttggagtaatagaactgagggagatatttggaataacctgacctggatgcaatgggatagagaaattagtaattactcagacacaatatacaggttgcttgaagcatcgcaaaaccagcaggaacaaaatgaaaaggatttattggccttgagcaattggcaaaatctgtggagttggtttaacatatcaaattggctgtggtatataagaatattcataatgatagtaggaggcttgataggtttaagaataatttttgctgtgctctctttagtgaataaagttaggcagggatactcacctttgtcgttgcagacccttaccccgaacccaaggggacccgacaggctcagaggaatcgaagaagaaggtggagagcaagacagagacagatccgttcgattagtgagcggattcttagcacttgcttgggacgacctgcggagcctgtgccttttcagctaccaccaattgagagacttcatattgattgtagcgagagcggtggaaattctgggacgcagggggtgggaagcccttaaatatctgggaagtcttgtgcagtactggggtctggaacttaaaaagagtgctattaatctgcttgatactatagcaatagcagtagctgaaggaacagataggattatagaattaatactaggacttggtagagctatctgcaacatacctagaagaataagacagggctttgaagcagctttgcaataactctagactagctaagggcgaattctgcagatatccatcacactggcggccgc

SEQ ID NO: 82 - DNA, 1494 bp, Artificial Sequence
  Description of Artificial Sequence: Gag of clone TV001G8 of isolate C-98TV001
atgggtgcgagagcgtcaatattaagcggcggaaaattagataaatgggaaagaattaggttaaggccagggggaaagaaacattatatgttaaaacatctagtatgggcaagcagggagctggaaagatttgcacttaaccctggcctgttagaaacatcagaaggctgtaaacaaataataaaacagctacaaccagctcttcagacaggaacagaggaacttagatcattattcaacacagtagcaactctctattgtgtacataaagggataaaggtacgagacaccaaggaagccttagacaagatagaggaagaacaaaacaaatgtcagcaaaaagcacagcaggcaaaagcggctgacgaaaaggtcagtcaaaattatcctatagtacagaatgcccaagggcaaatggtacaccaagctatatcacctagaacattgaatgcatgggtaaaagtaatagaggagaaggctttcaacccagaggtaatacccatgtttacagcattatcagaaggagccaccccacaagatttaaacaccatgttaaatacagtggggggacatcaagcagccatgcaaatgttaaaagataccatcaatgaggaggctgcagaatgggataggacacatccagtgcatgcagggcctgttgcaccaggccagatgagagaaccaaggggaagtgacatagcaggaactactagtacccttcaggaacaaatagcatggatgacaagtaatccacctattccagtaggagacatctataaaagatggataattctggggttaaataaaatagtaagaatgtatagccctgtcagcattttggacataaaacaagggccaaaagaaccctttagagattatgtagatcggttctttaaaactttaagagctgaacaagctacacaagatgtaaaaaattggatgacagacaccttgttggtccaaaatgcgaacccagattgtaagaccattttaagagcattaggaccaggggcttcattagaagaaatgatgacagcatgtcagggagtgggaggacctagccataaagcaagggtgttggctgaggcaatgagccaaacaaacagtaacatactagtgcagagaagcaattttaaaggccctaacagaattgttaaatgtttcaactgtggcaaagtagggcacatagccagaaagtgcagggcccctaggaaaaagggctgttggaaatgtggacaggaagggcaccaaatgaaagactgtactgagaggcaggctaattttttagggaaaatctggccttcccacaaggggaggccagggaatttcctccagaacagaccagagccaacagccccaccagcagagccaacagccccaccagcagagagcttcaggttcgaggagacaacccccgtgccgaggaaggagaaagacagggaacctttaacttccctcaaatcactctttggcagcgacccctcgtcacaataa

SEQ ID NO: 83 - DNA, 1494 bp, Artificial Sequence
  Description of Artificial Sequence: Gag of clone TV001G11 of isolate C-98TV001
atgggtgcgagagcgtcaatattaagcggcggaaaattagataaatgggaaagaattaggttaaggccagggggaaagaaacattatatgttaaaacatttagtatgggcaagcagagagctggaaagatttgcacttaaccctggcctgttagagacagcagaaggctgtaaacaaataataaaacagctacaaccagctcttcagacaggaacagaggaacttagatcattattcaacacagtagcaactctctattgtgtacataaaggaatagaggtacgagacaccaaggaagccttagacaagatagaggaagaacaaaacaaatgtcaacaaaaggcacaacaggcaaaagcggctgatgaaaaggtcagtcaaaattatcctatagtacagaatgcccaagggcaaatggtacaccaagctatatcacctagaacattgaatgcatgggtaaaagtaatagaggagaaggctttcaacccagaggtgatacccatgtttacagcattatcagaaggagccaccccacaagatttaaacacaatgttaaatacagtggggggacatcaagcagccatgcaaatgttaaaagataccatcaatgaggaggctgcagaatgggataggacacatccagtgcatgcagggcctgttgcaccaggccagatgagagaaccaaggggaagtgacatagcaggaactactagtacccttcaggaacaaatagcatggatgacaagtaatccacctattccagtaggggacatctataaaagatggataattctggggttaaataaaatagtaagaatgtatagccctgttagcattttggacataaaacaagggccaaaagaaccctttagagattatgtagatcggttctttaaaactttaagagctgaacaagctacacaagatgtaaaaaattggatgacagacaccttgttggtccaaaatgcgaacccagattgtaagaccattttaagagcattaggaccaggggcttcattagaagaaatgatgacagcatgtcagggagtgggaggacctagccataaagcaagggtgttggctgaggcaatgagccaaacaaacagtaacatactagtgcagagaagcaattttaaaggctctaacagaattgttaaatgtttcaactgtggcaaggtggggcacatagtcagaaattgcagggcccctaggaaaaagggctgttggaaatgtggacaggaagggcaccaaatgaaagactgtactgagagacaggctaattttttagggaaaatctggccttcccacaaggggaggccagggaatttcctccagaacagaccagagccaacagccccaccagcagaaccaacagccccaccagcagagagcttcaggttcgaggagacaacccccgtgccgaagagggagaaagagagggaacctttaacttccctcaaatcactctttggcaacgacccctcgtcacaataa

SEQ ID NO: 84 - DNA, 1464 bp, Artificial Sequence
  Description of Artificial Sequence: Gag of clone TV002G8 of isolate C-98TV002
atgggtgcgagagcgtcagtattgaaagggaaaaaattagatacatgggaaagaattaggttaaggccagggggaaagaaacactatatgctaaaacacctagtatgggcaagcagggagctggaaagatttgcacttaaccctggccttttagaaacagcagaaggctgtaaacaaataatgcaacagctacaatcagctcttcagacaggaacagaggaacttagatcattatataacacagtagcaactctctattgtgtacataaagagatagatgtacgagacaccaaggaagccttagacaagatagaggaagaacaaaataagagtcagcaaaaaacacagcaagcagaagcggctgacaaaggaaaggtcagtcaaaattatccaatagtgcagaatctccaagggcaaatggtacaccaggccatatcaccgagaactttaaatgcatgggtaaaagtaatagaagagaaggctttcagcccagaggtaatacccatgtttacagcattatcagaaggagctaccccacaagatttaaacaccatgttaaatacagtggggggacaccaagcagccatgcaaatgttaaaagataccatcaatgaggaggctgcagaatgggataggttacatccagtgcatgcagggcctattgcaccaggccaaatgagagaaccaaggggaagtgacatagcaggaactactagtacccttcaagaacaaatagcatggatgacaagtaacccacctattccggtgggagacatctataaaagatggataattctggggttaaataaaatagtaagaatgtatagccctgtcagcattttggacataaaacaagggccaaaagaaccctttagagactatgtagaccgattctttaaaactttaagggctgaacaatcttcacaagaggtaaaaaattggatgacagacaccttgttggtccaaaatgcaaacccagattgtaagaccattttaagagcattaggaccaggggctacattagaagaaatgatgacagcatgtcagggagtgggaggacctggccacaaagcaagagttttggctgaggcaatgagccaagcaaatacaaacataatgatgcagaaaagcaattttaaaggccctaaaagaactgttaaatgtttcaattgtggcaaggaagggcatatagccagaaattgcagggcccctaggaaaaagggctgttggaaatgtggaaaggaaggacaccaaatgaaagactgtactgaaaggcaggctaattttttagggaaaatttggccttcctacaaggggaggtcggggaatttccttcagagcagaccagagccatcagctccaccagcagagagcttcaggttcgaggagcgggagccgaaagacaaggaaccacccttaacttccctcaaatcactctttggcagcgacccctcgtcacaataa

SEQ ID NO: 85 - DNA, 1476 bp, Artificial Sequence
  Description of Artificial Sequence: Gag of clone TV003G15 of isolate C-98TV003
atgggtgcgagagcgtcaatattaagagggggaaaattagataaatgggaaaaaattaggttaaggccagggggaaagaaacgctatatgataaaacacctagtatgggcaagcagagagctggaaaaattcgcacttaaccctggccttttagagacatcagaaggatgtaaacagataatgaaacagctacaaccagctcttcagacaggaacagaggaacttagatcattattcaacaccatagcagttctctattgtgtacatgaaaagatagaggtacaagacaccaaggaagccttagacaagatagaggaagaacaaaacaaaagtcagcaaaaaacacagcaggcagcagcagctgacggaaaagtcagtcaaaattatcctatagtgcagaatgcccaagggcaaatggtgcaccagagcatatcacctaggactttgaatgcatgggtaaaagtaatagaggagaaggcttttagcccagaggtaatacccatgtttacagcattatcagaaggagccacctcacaagacttaaacaccatgctaaatacagtggggggacatcaagcagccatgcaaatgttaaaagataccatcaatgaggaggctgcagaatgggatagaatacatccagtacatgcggggcctattgcaccaggccaaatgagagaaccaaggggaagtgacatagcaggaactactagtacccttcaggaacaaatagcatggatgacaagtaatccacctatcccagtgggagacatctataaaagatggataattttggggttaaataaaatagtaagaatgtatagccctgtcagcattttggacataaaacaagggccaaaggaaccctttagagactatgtagacaggttctttaaaactttaagagctgaacaagctacacaagatgtaaaaaattggatgacagaaaccttgttggtccaaaatgcaaacccagattgtaagaccattttaagagggttaggaacaggggctacattagagggaatgatgacagcatgtcagggagtgggaggacctggccataaagcaagagtgttagctgaagcaatgagccaagcaacatataacataatgatgcagagaagcaattttaaaggctctagaaaaattgttaaatgtttcaactgtggcaggaaagggcacatagccagaaattgcagggcccctagaaaaaagggctgttggaaatgtggaaaggaaggacaccaaatgagagaatgtactgaaaagcaggctaattttttagggaaaatttggccttcccacaaggggaggccagggaatttccttcagagcagaccagagccaacagccccaccagcagagagcttcaggttcgaggagacaccccccgcgatgaagcaggaaccgaaagacagggaacccttaacttccctcaaatcactctttggcagcgacccctcgtcacaataa

SEQ ID NO: 86 - DNA, 1479 bp, Artificial Sequence
  Description of Artificial Sequence: Gag of clone TV004G17 of isolate C-98TV004
atgggtgcgagagcgtcaatattaagagggggaaaattagataaatgggaaaaaattaggttaaggccagggggaaagaaacattatatgataaaacacctagtatgggcaagcagggagctggaaagatttgcacttaaccctggccttttagagacagcagagggctgtaaacaaataataaaacagctacatccagctcttcagacaggaacagaggaacttagatcattatacaacaccgtggtaactctttattgcgtacatgcagagatagaggtacgagacaccaaggaagccttagacaagatagaggaagaacaaaacaaaagtcagcaaaaaacacagcaggcaaaagcggctgacggaaaagtcagtcaaaattatcctatagtacagaatctccaagggcgaatggtacaccaagccatatcacctagaaccttgaatgcatgggtaaaagtaatagaggaaaaggcttttagcccagaggtaatacccatgtttacagcattatcagaaggagccaccccccaagacttaaacaccatgttaaatacagtggggggacatcaagcagccatgcaaatgttaaaagataccatcaacgaggaggctgcagaatgggatagattacatccagcacaggcagggcctgttgcaccaggccaaataagagaaccaaggggaagtgacatagcaggaactactagtacccttcaggaacaaataacatggatgacaagtaacccacctgttccagtgggagaaatctataaaagatggataattctggggttaaataaaatagtaaggatgtatagccctgtcagcattttggacataaaacaagggccaaaggaaccctttagagactatgtagaccggttctttaaaactttaagagctgaacaggctacacaagaagtaaaaggctggatgacagacaccttattggtccaaaatgcgaacccagattgtaagaccattttaagagcattaggaccaggggctacactagaagaaatgatgacagcatgtcagggagtgggaggacctagccacaaggcaagagtgttggctgaggcaatgagccaaacaaacagtgcaagcataatgatgcagaaaagcaattttaaaggagccaaaagaattgttaaatgcttcaactgtggcaaggaggggcacatagccagaaattgcagggcccctaggaaaaaaggctgttggaaatgtggacaggaaggacaccaaatgaaagactgtactgagaggcaggctaattttttagggaaaatttggccttcccacaaaggaaggccagggaatttccttcagaacagaccagagccaacagcaccaccagcagagagcttcaggttcgaggagacaacacccactccgaagcaggagccgaaggacagggaacctttaacttccctcaaatcactctttggcagcgacccctcgtcacaataa

SEQ ID NO: 87 - DNA, 1479 bp, Artificial Sequence
  Description of Artificial Sequence: Gag of clone TV004G24 of isolate C-98TV004
atgggtgcgagagcgtcaatattaagagggggaaaattagataaatgggaaaaaattaggttaaggccagggggaaagaaacattatatgataaaacacctagtatgggcaagcagggagctggaaagatttgcacttaaccctggccttttagagacagcagagggctgtaaacaaataataaaacagctacatccagctcttcagacaggaacagaggaacttagatcattatataacaccgtggcaactctttattgcgtacatgcagagatagaggtacgagacaccaaggaagccttagacaagatagaggaagaacaaaacaaaagtcagcaaaaaacacagcaggcaaaagcggctgacggaaaagtcagtcaaaattatcctatagtacagaatctccaagggcaaatggtacaccaggccatatcacctagaaccttgaatgcatgggtaaaagtaatagaggaaaaggcttttagcccagaggtaatacccatgtttacagcattatcagaaggagccaccccccaagacttaaacaccatgttaaatacagtggggggacatcaagcagccatgcaaatgttaaaagataccatcaacgaggaggctgcagaatgggatagattacatccagcacaggcagggcctgttgcaccaggccaaataagagaaccaaggggaagtgacatagcaggaactactagtacccttcaggaacaaataacatggatgacaagtaacccacctgttccagtgggagaaatctataaaagatggataattctggggttaaataaaatagtaaggatgtatagccctgtcagcattttggacataaaacaagggccaaaggaaccctttagagactatgtagaccggttctttaaaactttaagagctgaacaggctacacaagaagtaaaaggctggatgacagacaccttattggtccaaaatgcgaacccagattgtaagaccattttaagagcattaggaccaggggctacactagaagaaatgatgacagcatgtcagggagtgggaggacctagccacaaggcaagagtgttggctgaggcaatgagccaaacaaacagtgcaagcataatgatgcagaaaagcaattttaaaggagccaaaagaattgttaaatgcttcaactgtggcaaggaggggcacatagccagaaattgcagggcccctaggaaaaaaggctgttggaaatgtggacaggaaggacaccaaatgaaagactgtactgagagacaggctaattttttagggaaaatttggccttcccacaaaggaaggccagggaatttccttcagaacagaccagagtcaacagcaccaccagcagagagcttcaggttcgaggagacaacacccactccgaagcaggagccgaaggacagggaacctttagcttccctcaaatcactctttggcagcgacccctcgtcacaataa

SEQ ID NO: 88 - DNA, 1468 bp, Artificial Sequence
  Description of Artificial Sequence: Gag of clone TV006G11 of isolate C-98TV006
atgggtgcgagcgtcaatattaaaagggggaaaattagatgcatgggaaagaattaggttaaggccagggggaaagaaacactatatgataaaacatttagtatgggcaagcagggagctggaaagatttgcacttaaccctggcctgttagagacatcagaaggatgtaaacaaataatgaaccagctacaaccatctcttcagacaggaacagaagaacttagatcattatacaacacagtagcaactctctattgtgtacatgaaaagatagaggtacgagacaccaaggaagccttagacaagatagaggaagaacaaaacaaaagccagcaaaaaacacaacaggcaaaagcggctggcgaaaaggtcagtcaaaattatcctatagtgcagaatgcccaagggcaaatggtacaccaagctatatcacctagaacgttaaatgcatgggtaaaagtaatagaggagaaggctttcagcccagaggtaatacccatgtttacagcattatcagaaggagccaccccacaagatttaaacaccatgttaaatacagtgggaggacatcaagcagccatgcaaatgttaaaagataccatcaatgaggaagctgcagaatgggatagggtacatccagtgcatgcagggcctgttgcaccaggacagatgagagaaccaaggggaagtgacatagcaggaactactagtaccctgcaggaacaaatagcatggatgacaagtaatccacctattccagtaggagaaatttataaaagatggataattctggggttaaataaaatagtaagaatgtatagccctgtcagcatcttggacataaaacaagggccaaaggaaccctttagggactatgtagaccggttctttaaaactttaagagccgaacaggctacacaagatgtaaaaaattggatgacagacaccttgttggtccaaaatgcgaacccagattgtaagaccattttaagagcattaggaccaggggcttcattagaagaaatgatgacagcatgtcagggagtgggaggacctagccacaaagcaagagtgttggctgaggcaatgagccaagcaaacaatataaacatactgatgcagagaagcaattttaagggctctaagagaattgttaaatgcttcaactgtggcaaggaagggcacatagccagaaattgcagggcccctaggaaaaagggctgttggaaatgtggaaaggaaggacaccaaataaaagactgtactgagaggcaggctaattttttagggaaaatttggccttcccgcaaggggaggccagggaatttccttcagaacaggccagagccaacagccccaccagcagaaagcttcaggttcgaggagacaacccctgcgccgaagcaggacaaggaacccttaacttccctcaaatcactctttggcagcgacccctcgtcacaataa

SEQ ID NO: 89 - DNA, 1470 bp, Artificial Sequence
  Description of Artificial Sequence: Gag of clone TV006G97 of isolate C-98TV006
atgggtgcgagagcgtcaacattaaaagggggaaaattagatgcatgggaaagaattaggttaaggccagggggaaagaaacactatatgataaaacatttagtatgggcaagcagggagctggaaagatttgcacttaaccctggcctgttagagacatcagaaggatgtaaacaaataatgaaccagctacaaccatctcttcagacaggaacagaagaacttagatcattatacaacacagtagcaactctctattgtgtacatgaaaagatagaggtacgagacaccaaggaagccttagacaagatagaggaagaacaaaacaaaagccagcaaaaaacacaacaggcaaaggcggctggcgaaaaggtcagtcaaaattatcctatagtgcagaatgcccaagggcaaatggtacaccaagctatatcgcctagaacgttaaatgcatgggtaaaagtaatagaggagaaggctttcagcccagaggtaatacccatgtttacagcattatcagaaggagccaccccacaagatttaaacaccatgttaaatacagtgggaggacatcaagcagctatgcaaatgttaaaagataccatcaatgaggaagctgcagaatgggatagggtacatccagtgcatgcaaggcctgttgcaccaggacagatgagagaaccaaggggaagtgacatagcaggaactactagtaccctgcaggaacaaatagcatggatgacaagtaatccacctattccagtaggagaaatttataaaagatggataattctggggttaaataaaatagtaagaatgtatagccctgtcagcatcttggacataaaacaagggccaaaggaaccctttagggactatgtagaccggttctttaaaactttaagagctgaacaagctacacaagatgtaaaaaattggatgacagacaccttgttggtccaaaatgcgaacccagattgtaagaccattttaagagcattagggccaggggcttcattagaagaaatgataacagcatgtcagggagtgggaggacctagccacaaagcaagagtgttggctgaggcaatgagccaagcaaacaatataaacatactgatgcagagaagcaattttaagggctctaagagaattgttaaatgcttcaactgtggcaaggaagggcacatagccaaaaattgcagagcccctaggaaaaagggctgttgaaaatgtagaaaagaaagacaccaaatgaaagactgtactgaaaggcaggctaattttttagggaaaatttggccttcccacaaggggaggccagggaatttccttcagaacaggccagagccaacagccccaccagcagaaagcttcaggttcgagaagacaacccctgcgccgaagcaggacaaggaacccttaacttccctcaaatcactctttggcagcgacccctcgtcacaataa

SEQ ID NO: 90 - DNA, 1500 bp, Artificial Sequence
  Description of Artificial Sequence: Gag of clone TV007G59 of isolate C-98TV009
atgggtgcgagagcgtcaatattaagagggggaaaattagataaatgggaagaaattaggttaaggccagggggaaagaaaacctataggctaaaacatctagtatgggcaagcagggagctggaaagatttgcacttaaccctggccttttagagacagcagaaggctgtaaacaaataataagacagctacacccagctcttcagacaggaacggaggaacttagatcattatacaacacagtagcaactctctattgtgtacatgcaaacatagaggtaaaagacaccaaggaagccttagacaagatagaggaagaacaaaacaaaagtcagcaaaaatcagagcaggcaaaagtaggtaacgaaaagatcagtcaaaattatcctatagtgcagaatctccaagggcaaatggtacaccaggccttatcacctagaactttgaatgcatgggtaaaagtaatagaggagaaggctttcagcccagaggtaatacccatgtttacagcattatcagaaggagccaccccacaagatttaaacaccatgttaaacacagtgggggggcatcaagcagccatgcaaatgttaaaagacaccatcaatgaagaggctgcagaatgggatcgattacacccagtacatgcagggcctattgcaccaggccaaatgagagaaccaaggggaagtgacatagcaggaactactagcacccttcaggaacaaatagcatggatgacaagtaacccacctattccggtgggagatatctataaaagatggataattctggggttaaataaaatagtaagaatgtatagccctgtcagcattttggacattaaacaagggccaaaggaaccctttagagactatgtagaccggttctttaaaactttaagagctgaacaagctacacaagatgtaaaaaattggatgacagacaccttgttggtccaaaatgcgaacccagattgtaagatcattttaagaggattaggaccaggggctacattagaagaaatgatgacagcatgtcagggagtgggaggacctagccacaaagcaagagtgttggctgaggcaatgagccaagcaaacagtggaaacataatgatgcagaaaagcaattttagaggctctaaaagaattattaaatgttttaactgtggcaaggaagggcacatagccaaaaattgtaaggcccctaggaaaagaggctgttggaaatgtggaaaggaaggacaccaaatgaaagactgtactgaaagacaggctaattttttagggaaaatttggccttcctgcaaggggaggccagggaatttccttcagaacaggccagagccaacagccccaccagcagagccaacagccccaccagcagagagcctcaggatcgaggaaacaacccccgctccgaagccggagccgagggacagggaacccttaatctccctcaaatcaccctttggcagcgacccctcgtcacaataa

SEQ ID NO: 91 - DNA, 1476 bp, Artificial Sequence
  Description of Artificial Sequence: Gag of clone TV008G65 of isolate C-98TV008
atgggtgcgagagcgtcagtattaagaggcgaaaaattagatacatgggaaaaaattaggttaaggccagggggaaagaaacgctatatgctaaaacacatagtatgggcaagcagggagctggaaagatttgcacttaaccctggccttttagagacatcagaaggctgtaaacaaataatacaacagctacaaccagctcttcagacaggaacagaggaacttaaatcgttattcaacacagtagcaactctctattgtgtacataaaaagatagaggttcgagacaccaaggaagccttagacaagatagaggaagaacaaaacaaaagtcagcaaaaaacacagcaggcagaagcggctgacaaaaaggtcagtcaaaattatcctatagtacagaacctccaagggcaaatggtacaccaagccctatcacctagaactttgaatgcatgggtaaaagtaatagaggagaaggcttttggcccagaggtaatacccatgtttacagcattatcagaaggagccaccccagcagatttaaacaccatgttaaatacagtggggggacatcaggcagccatgcagatgttaaaagataccatcaatgaggaggctgcagaatgggacagattacacccagtacatgcagggcctactgcaccaggccaaatgagagaacctaggggaagtgacatagcaggaactactagtacccttcaggaacaaatagctcggatgacaagtaacccacctgtcccagtgggagacatctataaaagatggataattctagggttaaataaaatagtaagaatgtatagccctgtcagcattttggacataaaacaggggccaaaagaaccctttagagactatgtagaccggttctttaaaactttaagagctgaacaagctacacaagaggtaaaaggttggatgacagacaccttgttggtccaaaatgcgaacccagattgtaagaccattttaagagcattaggaccaggggctacattagaagaaatgatgacagcatgtcagggagtgggaggacctggccacaaagccagagtgttggctgaggcaatgagccaagcaaacagtaacatacttatgcagagaagcaattttaaaggctctaaaagaattgttaaatgtttcaactgtggcaaggaagggcacatagccggaaattgcagggcccctagaaaaaagggctgttggaaatgtggaaaagaaggacaccaaatgaaagaatgtactgaaaggcaggctaattttttagggaaaatttggccttcccacaaggggaggccagggaatttcctccagagcagaccagagccaacagccccaccagcagagagcttcaggttcgaggagacaacccccgctccgaagcaggagtcgaaagacagggagcccttaacttccctcagatcactctttggcaacgacccctcgtcacaataa

SEQ ID NO: 92 - DNA, 1476 bp, Artificial Sequence
  Description of Artificial Sequence: Gag of clone TV008G66 of isolate C-98TV008
atgggtgcgagagcgtcagtattaagaggcgaaaaattggatacatgggaaaagattaggttaaggccagggggaaagaaacgctatatgctaaaacacatagtatgggcaagcagggagctggaaagatttgcacttaaccctggccttttagagacatcagaaggctgtaaacaaataatacaacagctacaaccagctcttcagacaggaacagaggaacttaaatcattattcaacacagtagcaactctctattgtgtacacagaaagatagaggtacgagacaccaaagaagccttagacaagatagaggaagaacgaaacaaaagtcagcaaaaaacacagcaggcagaagcggctgacaaaaaggtcagtcaaaattatcctatagtacagaatctccaagggcaaatggtacaccaggccctatcacctagaactttgaatgcatgggtaaaagtaatagaggagaaggcttttagcccagaggtaatacccatgtttacagcattatcagaaggagccaccccagcagatttaaacaccatgttaaatacagtggggggacatcaagcagccatgcagatgttaaaagataccatcaatgaggaggctgcagaatgggacagattacacccagtacatgcagggcctgctgcaccaggccaaatgagagaacctaggggaagtgacatagcaggaactactagtacccttcaggaacaaatagcatggatgacaagtaacccacctgtcccagtgggagacatctataaaagatggataattctagggttaaataaaatagtaagaatgtatagccctgtcagcattttggacataaaacaggggccaaaagaaccctttagagactatgtagaccggttctttaaaactttaagagctgaacaagctacacaagaggtaaaaggttggatgacagacaccttgttggtccaaaatgcgaacccagattgtaagaccattttaagagcattaggaccaggggctacattagaagaaatgatgacagcatgtcagggagtgggaggacctggccacaaagccagagtattggctgaggcaatgagccaagcaaacagtaacatatttatgcagagaagcaattttaaaggctctaaaagaattgttaaatgtttcaactgtggcaaggaagggcacatagccaaaaattgcagggcccctagaaaaaagggctgttggaaatgtggaaaagaaggacaccaaatgaaagactgtactgaaaggcaggctaattttttagggaaaatttggccttcccacaaggggaggccagggaatttcctccagagcagaccagagccaacagccccaccagcagagaacttcaggttcgaggagacaacccccgctccgaagcaggagtcgaaagacagggagcccttaacttccctcagatcactctttggcaacgacccctcgtcacaataa

SEQ ID NO: 93 - DNA, 1482 bp, Artificial Sequence
  Description of Artificial Sequence: Gag of clone TV010G74 of isolate C-98TV010
atgggtgcgagagcgtcaatattaagaggcggaaaattagataaatgggaaaaaattagattaaggccagggggaaagaaacactatatgttaaaacacatagtatgggcaagcagggagctggaaagatttgcacttaaccctggccttttagagacatcagaaggctgtaaacaaataatacaacagctacacacagctcttaagacaggaacagaggaacttacatcattatacaacacagtagcaactctctactgtgtacatgcagggatagaggtacgagacaccaaggaggccttagacaagatagaggaggagcaaaacaaaagtcagaaaaaaatgcagcaagcagaagtggctgacaaaaagaaggtcagtcaaaattatcctatagtacagaatcaccaagggcaaatggtacaccagaacatatcaccaagaactttaaatgcatgggtaaaagtaatagaggagaagggtttcaacccagaggtaatacccatgtttacagcattatcagagggagccaccccttctgatctgaacaccatgttaaatatagtggggggacatcaagcagccatgcaaatgttaaaagataccatcaatgaggaggctgcagaatgggatagattacacccagcacaggcagggcctgttgcaccaggccaaatcagagatccaaggggaagtgacatagcaggaactactagtacccttcaggaacaagtaacatggatgacaaataacccacctattccagtaggagacatctataaaagatggataattctgggattaaataaaatagtaagaatgtatagccctgtcagcattttggacattagacaaggaccaaaggagccttttagagactatgtagatcggttctttaaaactttaagagctgaacaagctacacaagatgtaaaaaattggatgacagacaccttgttggtccaaaatgcaaacccagattgtaagaccattttaagagcattaggaccaggggctacattagaagaaatgatgacagcatgtcaaggagtgggaggacctagccacaaagcaagagtcttggctgaggcaatgagccaagcaggcaatacaaacataatgatgcagaaaagcaatttcaaaggccctagaagaactattaaatgcttcaactgtggcaaggaaggacacctagccagaaattgcagggcccctaggaaaaaaggctgttggaaatgtggaaaggaaggacaccaaatgaaagactgtactgagaggcaggctaattttttagggaaaatttggccttcccactcggggaggccagggaacttccttcagaacagaccagagccaacagccccaccagcagagagcttcaggttcgaggagacaacccccgctcagaagcaggagccgcaagacagggaacccttaacttccctcaaatcactctttggcggcgacccctcgtcacaataa

SEQ ID NO: 94 - DNA, 1491 bp, Artificial Sequence
  Description of Artificial Sequence: Gag of clone TV012G34 of isolate C-98TV012
atgggtgcgagagcgtcaatattaagagggggaaaattagataaatgggaaaaaattaggttaaggccaggggggaaaaaacactatatgctaaaacacctagtatgggcaagcagagagctggaaagatttgcagttaaccctggccttttagagacatcagacggatgtagacaaataataaaacagctacaaccagctcttcagacaggaacagaggaaattagatcattatttaacacagtagcaactctctattgtgtacatgaagggatagatgtacgagacaccaaggaagccttagacaagttggaggaggaacaaaacaaatgtcagcaaaaaacacagcaggcagaagcggctgacaaaaaggtcagtcaaaattatcctatagtgcagaacctccaagggcaaatggtacaccaggccatatcacctagaaccttgaatgcatgggtaaaagtaatagaggagaaggcttttagcccagaggtaatacccatgtttacagcattatcagaaggagccaccccacaagatttaaacaccatgttaaatacagtggggggacatcaagcagccatgcaaatgttaaaagataccatcaatgaggaggctgccgaatgggataggttacatccagtacatgcagggcctgttgcaccaggccagatgagagaaccaaggggaagtgacatagcagaaactactagtacccttcaagaacaaatagcatggatgacaagtaacccacctatcccagtaggagacatctataaaaggtggataattctggggttaaataaaatagtaagaatgtacagccctgtcagcattttggacataaaacaaggaccaaaggaaccctttagagactatgtagaccggttcttcaaaactttaagagctgaacaatctacacaagaggtaaaaaattggatgacagacaccttgttagtccaaaatgcgaacccagattgtaagaccattttaagagcattaggaccaggggcttcattagaagaaatgatgacagcatgtcagggagtgggaggacctagccacaaagcaagagctttggctgaggcaatgagccaagcaaacaatgcaagtgtaatgatgcagaaaagcaattttaaaggccctagaagtactgttaaatgtttcaactgtggcaaggaagggcacatagccaggaattgcagggcccctaggaaaaaggactgttggaaatgtggaaaggaaggacaccaaatgaaagactgtactgagagacaggctaattttttagggaaaatttggccttcccacaaggggaggccagggaatttccttcagagcaggccagagccaacagccccaccactagagccaacagccccaccagcagagagcttcaagttcgaggagactccgaagcgggagccgaaagacagggaacccttaacttccctcaaatcactctttggcagcgacccctcgtcacaataa

SEQ ID NO: 95 - DNA, 1503 bp, Artificial Sequence
  Description of Artificial Sequence: Gag of clone TV012G40 of isolate C-98TV012
atgggtgcgagagcgtcaatattaagagggggaaaattagacaaatgggaaaaaattaggttaaggccaggggggaaaaaacgctatatgctaaaacacctagtatgggcaagcagagagctggacagatttgcagttaaccctggccttttagagacatcagacggatgtagacaaataataaaacagctacaaccagctcttcagacaggaacagaggaaattagatcattatttaacacagtagcaactctctattgtgtacataaagggatagatgtacgagacaccaaggaagccttagacaagatagaggaggaacaaaacaaatgccagcaaaaaacacagcaggcggaagcggctgacaaaaaggtcagtcaaaattatcctatagtgcagaacctccaagggcaaatggtacaccaggccatatcacctagaaccttgaatgcatgggtaaaagtaatagaggagaaggcttttagcccagaggtaatacccatgtttacagcattatcagaaggagccaccccacaagatttaaacaccatgttaaatacagtggggggacatcaagcagccatgcaaatgttaaaagataccatcaatgaggaggctgccgaatgggataggttacatccagtacatgcagggcctgttgcaccaggccagatgagagaaccaaggggaagtgacatagcagaaactactagtacccttcaagaacaaatagcatggatgacaagtaacccacctatcccagtaggagacatctataaaaggtggataattctggggttaaataaaatagtaagaatgtacagccctgtcagcattttggacataaaacaaggaccaaaagaaccttttagagactatgtagaccggttcttcaaaactttaagagctgaacaatctacacaagaggtaaaaaattggatgacagacaccttgttagtccaaaatgcgaacccagattgtaagaccattttaagagcattaggaccaggggcttcattagaagaaatgatgacagcatgtcagggagtgggaggacctacccacaaagcaagagttttggctgaggcaatgagccaagcaaacaatacaagtgtaatgatacagaaaagcaattttaaaggccctagaagagctgttaaatgtttcaactgtggcaaggaagggcacatagccaggaattgcagggcccctaggaaaaagggctgttggaaatgtggaaaggaaggacaccaaatgaaagactgtactgagagacaggctaattttttagggaaaatttggccttcccacaagggaaggccagggaatttccttcagagcagaccagagccaacagccccaccactagaaccaacagccccaccagcagagagcttcaagttcgaggagactccgaagcaggagccgaaagacagggaaccctacagggaacccttaacttccctcaaatcactctttggcagcgacccctcgtcacaataa

SEQ ID NO: 96 - DNA, 1527 bp, Artificial Sequence
  Description of Artificial Sequence: Gag of clone TV013G2 of isolate C-98TV013
atgggtgcgagagcgtcaatattaagagggacgaaattagatgcatgggaaaaaattaggttaaggccagggggaaagaaacattatatgttaaaacacctagtatgggcaagcagggagctggaaagatttgcacttaaccctggccttttagaaacatcggaaggctgtaaacaaataatgaaacagctacacccagctcttcagacaggaacagaggaacttaaatcattatacaacacagtagcaactctctattgtgtacatgaaagcataaaggtacgagacaccaaggaagccttagacaagatagaggaagaacaaaacaaaattaaaagtcagcaaaaaacacagcaggcaaaagcggctgacgaaaaagtcagtcaaaattatcctatagtgcagaatcttcaagggcaaatggtacatcagaacctatcacctagaaccttgaatgcatgggtaaaagtaatagaggagaaggcttttagcccagaggtaatacccatgtttacagcattatcagaaggagccaccccacaagatttaaacaccatgttaaatacggtggggggacatcaagcagccatgcaaatgttaaaagatcccatcaatgaagaggctgcagaatgggatagattacacccagtccatgcggggcctatggcaccaggccaattgagagaaccaaggggaagtgacatagcaggaactactagtacccttcaggaacaaatagcatggatgacaagtaatccacctatcccagtgggagacatctataaaagatggataattctggggttaaataaaatagtgagaatgtatagccctatcagcattttggacataagacaagggccaaaggaaccctttagagactatgtagaccggttctttaaagccttaagagctgaacaagctacacaagatgtaaaaaattggatgacagaaaccttgctggtccaaaatgcgaacccagattgtaagaccattttaaaagcattaggaataggggctacattggaagaaatgatgacagcatgtcagggagtggggggacctagtcacaaagcaagagtgttagctgaggcaatgagccaagcaaacaatacaaacataatgatgcagagaagcaattttaaaagctcaaaaagaattgttaaatgtttcaactgtggcaaggaagggcatatagccagaaattgcagggcccctaggaaaaagggctgttggaaatgtggaaaggaaggacaccaaatgaaagattgtactgagaggcaggcaaattttttagggaaaatttggccttcccacaaggggaggccagggaatttccttcagaacagaccagagccaacagccccaccagcagagagtttcaggaacagaccagagccaacggctccaccagcagagagcttcaggttcgaggagacaacccccactccgaagcaggagccgaaagacagggatcccttaacttccctcaaatcactctttggcagcgacccctcgtcacaataa

SEQ ID NO: 97 - DNA, 1527 bp, Artificial Sequence
  Description of Artificial Sequence: Gag of clone TV013G15 of isolate C-98TV013
atgggtgcgagagcgtcaatattaagagggacgaaattagatgcatgggaaaaaattaggttaaggccagggggaaagaaacattatatgttaaaacacctagtatgggcaagcagggagctggaaagatttgcacttaaccctggccttttagaaacatcagaaggctgtaaacaaataatgaaacagctacacccagctcttcagacaggaacagaggaacttaaatcattatacaacacagtagcaactctctattgtgtacatgaaaacataaaggtacgagacaccaaggaagccttagacaagatagaggaagaacaaaacaaaattaaaagtcagcaaaaaacacagcaggcaaaagcggctgacgaaaaagtcagtcaaaattatcctatagtgcagaatcttcaagggcaaatggtacatcagaacctatcacctagaaccttgaatgcatgggtaaaagtaatagaggagaaggcttttagcccagaggtaatacccatgtttacagcattatcagaaggagccaccccacaagatttaagcaccatgttaaatacggtggggggacatcaagcagccatgcaaatgttaaaagataccatcaatgaagaggctgcagaatgggatagattacacccagtccatgcggggcctatggcaccaggccaattgagagaaccaaggggaagtgacatagcaggaactactagtacccttcgggaacaaatagcatggatgacaagtaatccacctatcccagtgggagacatctataaaagatggataattctggggttaaataaaatagtgagaatgtatagccctgtcagcattttggacataagacaagggccaaaggaaccctttagagactatgtagaccggttctttaaagccttaagagctgaacaagctacacaagatgtaaaaaattggatgacagaaaccttgctggtccaaaatgcgaacccagattgtaagaccattttaaaagcattaggaataggggctacattggaagaaatgatgacagcatgtcagggagtggggggacctagtcacaaagcaagagtgttagctgaggcaatgagccaagcaaacaatacaaacataatgatgcagagaagcaattttaaaagctcaaaaagaattgttaaatgttccaactgtggcaaggaagggcatatagccagaaattgcagggcccctaggaaaaagggctgttggaaatgtggaaaggaaggacaccaaatgaaagattgtactgagaggcaggcaaattttttagggaaaatttggccttcccacaaggggaggccagggaatttccttcagaacagaccagagccaacagccccaccagcagagagtttcaggaacagaccagagccaacggctccaccagcagagagcttcaggttcgaggagacaacccccactccgaagcaggagccgaaagacagggatcccttaacttccctcaaatcactctttggcagcgacccctcgtcacaataa

SEQ ID NO: 98 - DNA, 1476 bp, Artificial Sequence
  Description of Artificial Sequence: Gag of clone TV014G73 of isolate C-98TV014
atgggtgcgagagcgtcaatattaagaggggaaaaattagataaatgggagaaaattaggctaaggccagggggaaggaaacactatatgctaaaacatctagtatgggcaagcagagagctggaaagattcgcacttaaccctggccttttagagacatcacaaggctgtaaacaaataataaaacagctacacccagctcttaagacaggaacagaggaacttaggtcattatacaacacagtagcaactctctattgtgtacatgaaaacatagaggtacgagacaccaaggaggccttagacaagatagaggaagaacaaaacaaaagtcagcaaaaaacacagcaggcaaaagcggctgacgaaggagtcagtcaaaattatcccatagtgcagaatctccaagggcaaatggtacaccaggccatatcacctagaactttgaatgcatgggtgaaagtaatagaggagaaggcttttagcccagaagtaatacccatgtttacagcattatcagaaggagccaccccacaagatttaaacaccatgttaaatacagtagggggacatcaagcagccatgcagatgttaaaagataccatcaatgaggaggctgcagaatgggatagattacatccagtccatgcagggcctgctgcaccaggccaaatgagggaacctagaggaagtgacatagcaggaactactagtacccttcaggaacaaatagcatggatgacaggtaacccacctgtcccagtgggagacatctataaaagatggataattctggggttaaataaaatagtaagaatgtatagccctgtcagcattttggacataaaacaagggccaaaggaaccctttagagactatgtagatcggttctttaaagttttaagagctgaacaagctacacaagatgtaaaaaattggatgacagacaccttgttgatccaaaatgcgaacccagattgtaagaccatcttaaaggcattgggaccagcggcttcattagaagaaatgatgacagcatgtcagggagtgggaggacctggccacaaagcaagagtgttggctgaggcaatgagccaagcaaacagtaacataatgatgcagagaagcaattttaaaggatctaaaagaattgttaaatgtttcaactgtggcaaggaagggcacatagccagaaattgcagggcccctagaaaaaagggctgttggaaatgtggacaagaaggacaccaaatgaaagactgtactgaaaggcaggctaattttttagggaaaatttggccttcccacaaggggaggccagggaatttcctccagagcaggccagagccaacagccccaccagcagagagcttcaggttcgaggaaacaacccccgctccgaaacaggagtcgaaggacagggaacccttaatttccctcaaatcactctttggcagcgacccctcgtcacaataa

SEQ ID NO: 99 - DNA, 1479 bp, Artificial Sequence
  Description of Artificial Sequence: Gag of clone TV018G60 of isolate C-98TV018
atgggtgcgagagcgtcaatattaaaaggcgaaaaattagatagatgggaaagaattaggttaaggccagggggaaagaaacattatatgttaaaacacatagtatgggcaagcagggagttggaaaaatttgcacttaaccctggccttttagaaacagcagaaggctgtaatcaaataatgaaccagctacaaccagctcttcagacaggaacagaggaacttaaatcattattcaacacagtagcaactctctattgtgtacataaaaagatagatgtacgagacaccaaggaagccttagataagatagaggaagaacaaaacaaaagtcagcaaaaaacacagcaggcaaaagcggctgacgaaaaggtcagtcaaaattatcctatagtacaaaatctccaagggcaaatggtacatcaagccatatcacctagaaccttgaatgcatgggtaaaagtaatagaggagaaggcctttagcccagaggtaatacccatgtttacagcattatcagaaggagccaccccacaagatttaaacaccatgttaaatacggtggggggacatcaagcagccatgcaaatgttaaaagataccatcaatgaggaggctgcagaatgggatagattacatccagtacatgcggggcctgttgcaccaggccaaatgagagaaccaaggggaagtgacatagcaggaactactagtacccttcaggaacaaatagcatggattacagctaacccacctattccagtaggagaaatctataaaagatggataattctggggttaaataaaatagtgagaatgtatagccctgtcagcattttggacataagacaaggaccaaaggaaccctttagagactatgtagatcggttctttaaaactttaagagctgaacaagctacacaagatgtaaaaaattggatgacagacaccttgttggtccaaaatgcgaacccagattgtaagaccattttaagagcattaggaccaggggctacattagaagaaatgatgacagcatgtcagggagtgggaggacctagccacaaagcaagagttttggctgaggcaatgagccaagcaaacaatgcagtcataatgatgcagaaaagcaattttaaaggtcctagaaaaattattagatgtttcaactgtggtaaggaagggcacatagccagaaactgcagggcccctaggaaaaaaggctgttggaaatgtggaaaggagggacaccaaatgaaagactgtactgaaaggcaggctaattttttagggaaaatttggccttcccacaaggggaggccagggaatttccttcagaacagaccagagccaacagccccaccagcagagagcttcaagttcgaggagacaacccccactccgaggcaggagtcgaaagacagggaacccttaacttccctcaaatcactctttggcagcgacccctcgtcacaataa

SEQ ID NO: 100 - DNA, 1479 bp, Artificial Sequence
  Description of Artificial Sequence: Gag of clone TV019G20 of isolate C-98TV019
atgggtgcgagagcgtcaatattaagaggcggaaaattagatacatgggaaaaaattaggttaaggccagggggaaagaaacactatatgctaaaacatctagtatgggcaagcagggagctggaaagatttgcacttaaccctggccttttagagacatcagaaggctgtaaacaaataataagacagctacaaccagctcttcagacaggaacagaggaacttaaatcattatataacacagtagcaactctctattgtgtacatgcaaagatagaggtacgagacaccaaggaagccttagacaggatagaggaagaacagaaaaaatgtcagcaaaaaacacagcaggcaaaagaggctgacgggaagatcagtcaaaattatcctatagtgcagaatcttcaagggcaaatggtacaccaggccatatcacctagaactttgaatgcatgggtaaaagtaatagaggagaaggcttttagcccagaagtaatacccatgtttacagcattatcagaaggagccaccccacaagatttaaacaccatgctaaatacagtggggggacatcaagcagccatgcaaatgttaaaagataccatcaatgaggaggctgcagaatgggacagaatacatccagtacatgcagggcctattgcaccaggccaaatgagagaaccaaggggaagtgacatagcaggaactactagtacccttcaggaacaaatagcatggatgacaagtaacccacctgttccagtgggagaaatctataaaagatggataattctgggcctaaataaaatagtaagaatgtatagccctgtcagcattttggacataaaacaaggaccaaaggaaccctttagagattatgtagatcggttctttaaaactttaagagccgaacaagctacacaagatgtaaaaaattggatgacagacaccttgttggtccaaaatgcgaacccagattgtaagatcattttaagaggattaggaccaggggctacattagaagaaatgatgacagcatgtcagggagtgggaggacctggccacaaagcaagagtgttggctgaggcaatgagccaagcaaacagtacaaatataatgatgcagagaggcaattttaaaggccctaaaagaaacattaaatgttttaactgtggcaaggaagggcacctagccagaaattacagggcccctaggaaaaaaggttgttggaaatgtggaaaagaaggacaccaaatgaaagactgtacagagagacaggctaattttttagggaaaatttggccttcccacaagggaaggccagggaacttccttcagaacagaacagagccaacagccccaccagcagagagcttcaggttcgaggagacaaaccctgctccgaagcaggagccgaaagacagggaacccttaacttccctcaaatcactctttggcagcgacccctcgtcacaataa

SEQ ID NO: 101 - DNA, 1479 bp, Artificial Sequence
  Description of Artificial Sequence: Gag of clone TV019G25 of isolate C-98TV019
atgggtgcgagagcgtcaatattaggaggcggaaaattagatacatgggaaaaaattaggttaaggccagggggaaagaaacactatatgctaaaacatctagtatgggcaagcagggagctggaaagatttgcacttaaccctggccttttagagacatcagaaggctgtaaacaaataataagacaactacaaccagctcttcagacaggaacagaggaacttaaatcattatacaacacagtagcaactctctattgtgtacatgcaaagatagaggtacgagacaccaaggaagccttagataagatagaggaagaacagaaaaaatgtcagcaaaaaacacagcaggcaaaagaggctgacgggaagatcagtcaaaattatcctatagtgcagaatcttcaagggcaaatggtacaccaggccatatcacctagaactttgaatgcatgggtaaaagtaatagaggagaaggcttttagcccagaagtaatacccatgtttacagcattatcagaaggagccaccccacaagatttaaacaccatgctaaatacagtggggggacatcaagcagccatgcaaatgttaaaagataccatcaatgaggaggctgcagaatgggacagaatacatccagtacatgcagggcctattgcaccaggccaaatgagagaaccaaggggaagtgacatagcaggaactactagtacccttcaggaacaaatagcatggatgacaagtaacccacctgttccagtgggagaaatctataaaagatggataattctgggcctaaataaaatagtaagaatgtatagccctgtcagcattttggacataaaacaaggaccaaaggaaccctttagagattatgtagaccggttctttaaaactttaagagccgaacaagctacacaagatgtaaaaaattggatgacagacaccttgttggtccaaaatgcgaacccagattgtaagatcattttaagaggattaggaccaggggctacattagaagaaatgatgacagcatgtcagggagtgggaggacctggccacaaagcaagagtgttggctgaggcaatgagccaagcaaacagtacaaatataatgatgcagagaggcaattttaaaggccctaaaagaaacattaaatgttttaactgtggcaaggaagggcacctagccagaaattgcagggcccctaggaaaaagggttgttggaaatgtggaaaagaaggacaccaaatgaaagactgtacagagagacaggctaattttttagggaaaatttggccttcccacaagggaagaccagggaacttccttcagaaccgaacagagccaacagccccaccagcagagagcttcaggttcgaggagacaaaccctgctccgaagcaggagccgaaagacagggaacccttaacttccctcaaatcactctttggcagcgacccctcgtcacaataa

SEQ ID NO: 102 - protein, 205 aa, Artificial Sequence
  Description of Artificial Sequence: Nef TV001
MGGKWSKCSGWPAVRERMRRAEPAAEGVGPASQDLDRHGALTSSNTPANNDACAWLQAQEEDEDVGFPVRPQVPLRPMTYKSAFDLSFFLKEKGGLDGLVYSKKRQEILDLWVYNTQGFFPDWQNYTPGPGVRYPLTFGWCYKLVPVDPGEVEEANGGEDNCLLHPMSQHGAEDEDREVLKWKFDSLLARRHMARELHPEYYKDC

SEQ ID NO: 103 - protein, 207 aa, Artificial Sequence
  Description of Artificial Sequence: Nef TV002
MGGKWSKSSIVGWPAVRERIRRTEPAAEGVGAASKDLDKHGALTSSNTAATNADCAWLEAQEEEEEVGFPVRPQVPLRPMTYNAAIDLSFFLKEKGGLEGLIYSKKRQEILDLWVYNTQGFFPDWQNYTPGPGVRYPLTFGWCFKLEPVDPKEVEEANEGENNCLLHPMSQHGMEDEDREVLRWKFDSMLARRHMARELHPEYYKDC

SEQ ID NO: 104 - protein, 207 aa, Artificial Sequence
  Description of Artificial Sequence: Nef TV003
MGGKWSKSSIVGWPAVRERIRKTEPAAQGVGAASQDLDKYGALTSSNTAANNADCAWLQAQEEEEEVGFPVRPQVPVRPMTYKAAFDLSFFLKEKGGLDGLIHSQKRQDILDLWVYHTQGFFPDWQNYTPGPGVRYPLTFGWCFKLVPVDPREVEEANKGEDGCLLHPMSQHGIDDVHKEVLMWKFDSHLARTHMAREIHPEFYKDC

SEQ ID NO: 105 - protein, 209 aa, Artificial Sequence
  Description of Artificial Sequence: Nef TV004
MGGKWSKSSRAGWPEIRERIRRARSARAAEGVGAASQDLDKHGALTTSNTATNNAACAWLEAQEEEGEVGFPVRPQVPLRPMTYKAAFDLSFFLKEKGGLEGLIYSKKRQEILDLWVYHTQGYFPDWQNYTPGPGTRFPLTFGWCFKLVPVDPKEVEEANEGENNCLLHPMSQHGMEDEDREVLVWKFDSLLARRHMARELHPEWYKDC

SEQ ID NO: 106 - protein, 207 aa, Artificial Sequence
  Description of Artificial Sequence: Nef TV005
MGNKWSKSSIVGWPAVRERIRRTEPAAEGVGAASQDLDKYGALTSSNTAHNNADCAWLQAQEEEEGVGFPVRPQVPLRPMTYKAAFDLSFFLKEKGGLDGLIHSKKRQEILDLWVHHTQGFFPDWQNYTPGPGVRYPLTFGWCFKLVPVDPREVEEANKGENNCLLHPMSQHGIEDEEREVLQWKFDSSLARRHLAREKHPEFYKDC

SEQ ID NO: 107 - protein, 210 aa, Artificial Sequence
  Description of Artificial Sequence: Nef TV006
  SITE (13): where Xaa is a stop codon
MGNKWSKSWPAIXERMRRAMPATEGAAEGAAAGVGAASRDLDRHGALTSSNTASTNADCAWLEAQEEEEVGFPVRPQVPLRPMTYKGAFDLSFFLKEKGGLEGLVYSKKRQEILDLWVYHTQGYFPDWQNYTPGPGVRYPLTFGWCFKLVPVDPKEVEEANEGENNSLLHPISLHGMEDDDREVLVWKFDSLLARRHMARELHPEYYKDC

SEQ ID NO: 108 - protein, 207 aa, Artificial Sequence
  Description of Artificial Sequence: Nef TV007
MGGKWSKSSIVGWPAIRERIRRTEPAAEGVGAASRDLDKHGALTSSNTSANNADCAWLEAQEEEGEVGFPVRPQVPLRPMTYKGAFDLSFFLKEKGGLEGLIYSKKRQDILDLWVYHTQGFFPDWQNYTPGPGVRYPLTFGWCYKLVPVDPREVEEANKGENNCLLHPISQHGIEDEEREVLQWKFDSLLARRHMARELHPEYYKDC

SEQ ID NO: 109 - protein, 207 aa, Artificial Sequence
  Description of Artificial Sequence: Nef TV008
MGGKWSKSSIVGWPAVRERMRRTAPAAEGVGAASQDLDKHGALTSSNTVSNNAACAWLEAQEEEGEVGFPVRPQVPLRPMTYKAAFDLGFFLKEKGGLDGLIYSKKRQEILDLWVYHTQGFFPDWQNYTPGPGVRYPLTYGWCYKLVPVDPREVEEANKGENNCLLHPMSQHGMEDEDREVLQWQFDSSLARRHMARELHPEYYKDC

SEQ ID NO: 110 - protein, 206 aa, Artificial Sequence
  Description of Artificial Sequence: Nef TV010
MGGKWSKSSIVGWPAVRERIRRTEPAAQGVGAASKDLDKHGALTSSNTAATNADCAWLEAQEEEEVGCPVRPQVPLRPMTYKAAFDLGFFLKEKGGLDGLIYSKKRQEILDLWVYHTQGFFPDWQNYTPGPGVRYPLTFGWCYKLVPVDPREVEEANTGEDNCLLHPMSQHGMEDADREVLKWKFDSQLARRHMARELHPDFYKDC

SEQ ID NO: 111 - protein, 203 aa, Artificial Sequence
  Description of Artificial Sequence: Nef TV012
MGNKWSKSWSTVRERMRKTQPAAAEGVGAASQDLDKRGALTINNTASNNPDCAWLEAQEDEEVGFPVRPQVPLRPMTYKAAFDLSFFLKEKGGLEGLIYSRKRQEILDLWVYHTQGYFPDWQNYTPGPGVRYPLTFGWCFKLVPVDPREVEEANGGGDNCLLHPMSQYGMDDEHKEVLQWKFDSSLARRHLARELHPDYYKDC

SEQ ID NO: 112 - protein, 207 aa, Artificial Sequence
  Description of Artificial Sequence: Nef TV013
MGSKWSKNCIVGWPTVRERIRQTEPAAEGVGAASQDLDKHGALTVSNTAHNNADCAWLQAQEEEEEVGFPVRPQVPLRPMTYKGAFDLSFFLKEKGGLEGLIYSKKRQDILDLWVYHTQGYFPDWHNYTPGPGVRYPLTFGWCFKLVPVDPGEVEEANEGENNCLLHPMSQHGMEDAEREVLKWKFDSSLARRHLARELHPEYYKDC

SEQ ID NO: 113 - protein, 207 aa, Artificial Sequence
  Description of Artificial Sequence: Nef TV014
MGGTWSKSKLVGWSTVRERMRRAEPAAEGVGAVSQDLDRHGAITSSNTATTNADCAWLEAQEESEEVGFPVKPQVPLRPMTYKSAFDLSFFLKEKGGLDGLIYSKKRQDILDLWVYHTQGFFPDWQNYTSGPGVRYPLTFGWCYKLVPVDPREVEEANKGENNCLLHPMSLHGMEDEEGEVLQWKFDSSLARRHLARELHPEYYKDC

SEQ ID NO: 114 - protein, 207 aa, Artificial Sequence
  Description of Artificial Sequence: Nef TV018
MGGKWSKSSIVGWPAVRERIRRAEPAAEGVGAASQDLDKYGALTSSNTPHNNADCAWLQAQEEGEEVGFPVRPQVPLRPMTYKSAFDLSFFLKEKGGLEGLIYSKKRQDILDLWVYHTQGFFPDWQNYTPGPGIRYPLTFGWCFKLVPVDPSEVEEANKGENNCLLHPMSQHGMEDDHREVLKWKFDSSLARRHIAREQHPEWYKDC

SEQ ID NO: 115 - protein, 207 aa, Artificial Sequence
  Description of Artificial Sequence: Nef TV019
MGGRWSKSSKIGWPAVRERIRRTEPAAEGVGAASQDLDKHGALTSSNTVSNNADCAWLEAQEEEGEVGFPVRPQVPLRPMTYKGAFDLSFFLKEKGGLEGLIYSKKRQEILDLWVYHTQGFFPDWQNYTPGPGIRYPLTFGWCFKLVPVDPKEVEEANEGENSCLLHPMHLHGMEDEHREILKWKFDSHLAYKHTARELHPEFYKDC

SEQ ID NO: 116 - protein, 191 aa, Artificial Sequence
  Description of Artificial Sequence: Nef 92BR025
IRERMRRAPAAEGVGPASQDSDKYGALTSSSTPANNADCAWLEAQQEEEEVGFPVRPQVPLRPMTYKAVVDLSFFLEEKGGLEGLIYSKKRQDILDLWVYNTQGYFPDWQNYTPGPGVRFPLTFGWCFKLVPVDPREVEEANTGENNSLLHPMSLHGMEDSHREVLQWKFDSLLARRHMARELHPEYYKDC

SEQ ID NO: 117 - protein, 207 aa, Artificial Sequence
  Description of Artificial Sequence: Nef 301904-Ind
MGGKWSKCSIVGWPDIRERMRRTQPAAEGVGAASQDLDKYGALTSSNTDITNPDCAWLKAQEEEEEVGFPVRPQVPLRPMTFKEAVDLSFFLKEKGGLEGLIYSKKRQEILDLWVYHTQGYFPDWQNYTPGPGVRYPLTFGWCFKLVPVDPREVEEANEGEDNCLLHPVCQHGMDDEHREVLQWKFDSLLAHRHRARELHPEFYKDC

SEQ ID NO: 118 - protein, 207 aa, Artificial Sequence
  Description of Artificial Sequence: Nef 301905-Ind
MGGKWSKSSIVGWPAIRERMRRAEPAAEGVGAASQDLDKYGALTSSNTDTTNADCAWLRAQEEEEEVGFPVTPQVPLRPMTYKGAFDLSFFLKEKGGLEGLIHSKKRQEILDLWVYHTQGYFPDWQNYTPGPGVRYPLTFGWCFKLVPVDPREVEEASEGEDNCLLHPVCQHGMEDEHREVLRWKFDSQLAHRHKARELHPEFYKDC

SEQ ID NO: 119 - protein, 207 aa, Artificial Sequence
  Description of Artificial Sequence: Nef 301999-Ind
MGGKWSKCSIVGWPAVRERMRRTEPAAEGVGAASQDLDKYGALTSSNTDTTNADCAWLRAQEEEEEVGFPVRPQVPLRPMTFKGAFDLSFFLKEKGGLEGLIYSKKRQEILDLWVYHTQGFFPDWQNYTPGPGVRFPLTFGWCFKLVPVDPREVEEANEGENNCLLHPVCQHGMEDEHREVLQWKFDSHLAHRHMARELHPEYYKDC

SEQ ID NO: 120 - protein, 196 aa, Artificial Sequence
  Description of Artificial Sequence: Nef 96BW16-D14
MGGKWSKWPAVRERMRRTRVGAGYQDLDKDRALTSSNTDTNNAAAACAPQEEEDEVGFPVRPQVPLRPMTYKEAFDLSFFLKEKGGLDGLIYSRKRQDILDLWVYNTQGFLPDWQNYTPGPGVRYPLTFGWCFKLVPVDPREVEEETQGENNCLLHPMNQHGMEDPEREVLKWKFDSHLARRHMARELHPEYYKDC

SEQ ID NO: 121 - protein, 207 aa, Artificial Sequence
  Description of Artificial Sequence: Nef 96BW04-09
MGGKWSKSSIVGWPAVRERMRRAEPAAEGVGTASQDLDKYGALTTNNTATNNAACAWLEAQKEEEEVGFPVRPQVPLRPMTYKAAVDLSFFLKEKGGLEGIIYSKKRQDILDLWVYNTQGYFPDWQNYTPGPGVRYPLTFGWCYKLVPVDPREVEEANEGENNRLLHPMSLHGMEDDDREVLRWKFDSSLAHRHMARELHPEYYKDC

SEQ ID NO: 122 - protein, 207 aa, Artificial Sequence
  Description of Artificial Sequence: Nef 96BW12-10
MGNKWSKGWPAVRDRIRRTEPATEPAAEGVGSASKDLEKHGALTTSNTAANNPHCAWLEAQEEEEEVGFPVRPQVPLRPMTYKGAFDLSFFLKEKGGLDGLIYSKKRQEILDLWVYNTQGYFPDWQCYTPGPGVRYPLTFGWCFKLVPVDPGEVEEANGGEDNCLLHPMSQHGIEDADREVLKWKFDSSLARRHLTREKHPEYYKDC

SEQ ID NO: 123 - protein, 207 aa, Artificial Sequence
  Description of Artificial Sequence: Nef C2220-Eth
MGGTMSKCSPVGWPAIRERIRRAAPAAEGVGAASRDLDKYGALTSSNTPANNPDCAWLEAQEEEEEVGFPVRPQVPLRPMTYKAAFDLSLFLKEKGGLEGLIYSKKRQEILDLWVYNTQGFFPDWQNYTPGPGVRYPLTFGWCFKLVPVDPSEVEEINEGENNCLLHPASLHGMEDEDREVLKWKFDSHLARRHMARELHPEYYKDC

SEQ ID NO: 124 - protein, 206 aa, Artificial Sequence
  Description of Artificial Sequence: Nef HXB2
  SITE (124): where Xaa = HXB2 premature stop
MGGKWSKSSVIGWPTVRERMRRAEPAADRVGAASRDLEKHGAITSSNTAATNAACAWLEAQEEEEVGFPVTPQVPLRPMTYKAAVDLSHFLKEKGGLEGLIHSQRRQDILDLWIYHTQGYFPDXQNYTPGPGVRYPLTFGWCYKLVPVEPDKIEEANKGENTSLLHPVSLHGMDDPEREVLEWRFDSRLAFHHVARELHPEYFKNC

SEQ ID NO: 125 - protein, 215 aa, Artificial Sequence
  Description of Artificial Sequence: Nef Consensus
MGGKWSKSSIVGWPAVRERIRRTEPATEGAAEGAAEGVGAASQDLDKHGALTSSNTAANNADCAWLEAQEEEEEVGFPVRPQVPLRPMTYKAAFDLSFFLKEKGGLEGLIYSKKRQEILDLWVYHTQGFFPDWQNYTPGPGVRYPLTFGWCFKLVPVDPREVEEANEGENNCLLHPMSQHGMEDEDREVLKWKFDSSLARRHMARELHPEYYKDC

SEQ ID NO: 126 - protein, 867 aa, Artificial Sequence; identical to SEQ ID NO: 3
  Description of Artificial Sequence: TV001c8.2

SEQ ID NO: 127 - protein, 870 aa, Artificial Sequence
  Description of Artificial Sequence: TV001c8.1
MRVMGTQKNCQQWWIWGILGFWMLMICNTEDLWVTVYYGVPVWREAKTTLFCASDAKAYETEVHNVWATHACVPTDPNPQEIVLGNVTENFNMWKNNMADQMHEDIISLWDQSLKPCVKLTPLCVTLNCTDTNVTGNRTVTGNTNDTNIANATYKYEEMKNCSFNATTELRDKKHKEYALFYKLDIVPLNENSNNFTYRLINCNTSTITQACPKVSFDPIPIHYCAPADYAILKCNNKTFNGTGPCYNVSTVQCTHGIKPVVSTQLLLNGSLAEEGIIIRSENLTENTKTIIVHLNESVEINCTRPNNNTRKSVRIGPGQAFYATNDVIGNIRQAHCNISTDRWNKTLQQVMKKLGEHFPNKTIKFEPHAGGDLEITMHSFNCRGEFFYCNTSNLFNSTYYPKNGTYSKYNGNSSLPITLQCKIKQIVRMWQGVGQAMYAPPIAGNITCRSNITGILLTRDGGFNNTNNDTEETFRPGGGDMRDNWRSELYKYKVVEIKPLGIAPTKAKRRVVQRKKRAVGIGAVFLGFLGAAGSTMGAASITLTVQARQLLSGIVQQQSNLLKAIEAQQHMLQLTVWGIKQLQARVLAIERYLKDQQLLGIWGCSGRLICTTAVPWNSSWSNKSEADIWDNMTWMQWDREINNYTETIFRLLEDSQNQQEKNEKDLLELDKWNNLWNWFDISNWLWYIKIFIMIVGGLIGLRIIFAVLSIVNRVRQGYSPLSFQTLTPSPRGLDRLGGIEEEGGEQDPDRSIRLVSGFLSLAWDDLRSLCLFSYHRLRDFILIAVRAVELLGHSSLRGLQRGWEILKYLGSLVQYWGLELKKSAISPLDTIAIAVAEGTDRIIELVQRICRAILNIPRRIRQGFEAALL

SEQ ID NO: 128 - protein, 854 aa, Artificial Sequence; identical to SEQ ID NO: 5
  Description of Artificial Sequence: TV002c12.1

SEQ ID NO: 129 - protein, 845 aa, Artificial Sequence
  Description of Artificial Sequence: TV012c2.1
MRVMGSRRNYQQWWIWGVLGFWMLMVGNVMGNLWVTVYYGVPVWKEAKATLFCASDAKAYEKEVHNVWATHACVPTDPDPQEIVLENVTENFNMWKNNMVDQMHEDIISLWDQSLKPCVKLTPLCVTLNCSNNVKNATNSMKEMKNCTFNITTELRDKRKQEYALFYKLDIVPLEENSSKYRLINCNTSAITQACPKVSFDPIPIHYCAPAGYAILKCNNKTFNGTGPCNNVSTVQCTHGIKPVVSTQLLLNGSLAEEEIVIRSENMTNNAKIIIVHLNESVEITCTRPNNNTRKSMRIGPGQTFYATGDIIGDIRQAHCNISEKQWDQTLYRVSEKLKEHFPNKTIKFNSSSGGDLEITTHSFNCGGEFFYCNTSALFNGIYSNGTNSTNTTVITLQYRIRQIINMWQGVGRAMYAPPIAGNITCRSNITGLILTRDGGEGNGTNTDEIFRPAGGDMRDNWRSELYKYKVVEIQPLGVAPTKAKRRVVEREKRAALGAVFLGFLGAAGSTMGAASITLTVQARQLLSGIVQQQSNLLRAVEAQQHMLQLTVWGIKQLQTRVLAIERYLKDQQLLGIWGCSGKLICTTAVPWNNSWSNKSQDYIWGNMTWMQWDKEINNYTDTIYRLLGDAQNQQEENEKELLELDRWGNLWNWFDMTSWLWYIKIFIMVIGGLIGLRIIFAVLSIVNRVRQGYSPLSFQTLAQNPRGPDRLGRTEEEGGEQDRDRSIRLVSGFLALAWEDLRNLCIFLYHRLRDFVLVTARAVELLGRSSLRGLQRGWEILKYLGSLVQYWGLELKKSAVSLLDSLAIAVAEGTDRIIEFLQGIGRAIYNIPRRIRQGFEAALQ

SEQ ID NO: 130 - protein, 845 aa, Artificial Sequence
  Description of Artificial Sequence: TV012c2.2
MRVMGSRRNYQQWWIWGILGFWMLMVGNVMGNLWVTVYYGVPVWKEAKATLFCASDAKAYEKEVHNVWATHACVPTDPDPQEIVLENVTENFNMWKNNMVDQMHEDIISLWDQSLKPCVKLTPLCVTLNCSNNVKNATNSMKEMKNCTFNITTELRDKRKQEYALFYKLDIVPLEENSSKYRLINCNTSAITQACPKVSFDPIPIHYCAPAGYAILKCNNKTFNGTGPCNNVSTVQCTHGIKPVVSTQLLLNGSLAEEEIVIRSENMTNNAKIIIVHLNESVEITCTRPNNNTRKSMRIGPGQTFYATGDIIGDIRQAHCNISEKQWDQTLYRVSEKLKEHFPNKTIKFNSSSGGDLEITTHSFNCGGEFFYCNTSALFNGIYSNGTNSTNTTVITLQYRIRQIINMWQGVGRAMYAPPIAGNITCRSNITGLILTRDGGEGNGTNTDEIFRPAGGDMRDNWRSELYKYKVVEIQPLGVAPTKAKRRVVEREKRAALGAVFLGFLGAAGSTMGAASITLTVQARQLLSGIVQQQSNLLRAVEAQQHMLQLTVWGIKQLQTRVLAIERYLKDQQLLGIWGCSGKLICTTAVPWNNSWSNKSQDYIWGNMTWMQWDKEINNYTDTIYRLLGDAQNQQEENEKELLELDRWGNLWNWFDMTSWLWYIKIFIMVIGGLIGLRIIFAVLSIVNRVRQGYSPLSFQTLAQNPRGPDRLGRTEEEGGEQDRDRSIRLVSGFLALAWEDLRNLCIFLYHRLRDFVLVTARAVELLGRSSLRGLQRGWEILKYLGSLVQYWGLELKKSAVSLLDSLAIAVAEGTDRIIEFLQGIGRAIYNIPRRIRQGFEAALQ

SEQ ID NO: 131 - protein, 851 aa, Artificial Sequence
  Description of Artificial Sequence: TV006c9.1
MRVTGILRNYPQWWIWVILGFIIYNVGGMWVTVYYGVPVWKEAKTTLFCASDAKAYDKEVHNVWATHACVPTDPNPQELVLENVTENFNMWKNDMVDQMHEDIISLWDESLKPCVKLTPLCVTLNCKANVTVNTTNFNDSMIEQMRNCSFNITTELRDKKKQVYALFYKLDIIQLDNDNSSDNSGYRLINCNTSAITQACPKVTFDPIPIHYCAPAGYAILKCNNKTFNGTGPCSNVSTVQCTHGIKPVVSTQLLLNGSLAEGDIIIRSQNLTNNAKIIIVHLNESVEIVCTRPGNNTRQSIRIGPGQTFYATGDIIGDIRQAHCNISAGKWNETLKRVSKKLGEHFPNKTIKFAPHSGGDLEITMHSFNCRGEFFYCNTSSLFNSSYNTSDLFNSNNGSAITLPCRIKQIVNMWQGVGRAIYAPPIAGNITCNSSITGLLLVRDGGNTTNSTEIFRPEGGNMRDNWRSESYKYKVVEIKPLGIAPTNAKRRVVEREKRAVTLGAMFLGFLGAAGSTMGAASITLTAQARQLLSGIVQQQSNLLRAIETQQHMLQLTVWGIKQLQARVLAIERYLKDQQLLGIWGCSGKLICTTAVPWNSSWSNKTEKDIWENMTWMQWDREISNYTDIIYNLLEVSQIQQEQNKKDLLALDSWKILWSWFDISSWLWYIRIFIMIVGGLIGLRIISAVLSIVNRVRQGYSPLSFQTLAPNPRELDRLGRIEEEGGEQDRDRSIRLVQGFLALAWDDLRSLCLFSYHRLRDFILIAAKAAELLGHNSLRGLQRGWEILKYLGSLAQYWGLELKKSAISLLDTIAIAVAEGTDRIIELIQRIWRAIRNTPRRIRQGFEAALQ

SEQ ID NO: 132 - protein, 857 aa, Artificial Sequence
  Description of Artificial Sequence: TV006cE9
MRVTGILRNYPQWWIWVILGFWIIYNVGGNMWVTVYYGVPVWKEAKTTLFCASDAKAYDKEVHNVWATHACVPTDPNPQDLVLENVTENFNMWKNDMVDQMHEDIISLWDESLKPCVKLTPLCVTLNCKANVTVKTNANVTVNTTNFNDSMIEQMRNCSFNITTELRDKKKQVYALFYRLDIVQFDNDNSSYRLINCNTSAITQACPKVTFDPIPIHYCAPAGYAILKCNNKTFNGTGPCSNVGTVQCTHGIKPVVSTQLLLNGSLAEGDIIIRSQNLTNNAKIIIVHLNESVEIVCTRPGNNTRQSIRIGPGQTFYATGDIIGDIRQAHCNISAGKWNETLKRVSKKLGEHFPNKTIKFAPHSGGDLEITMHSFNCRGEFFYCNTSSLFNSSYNTSGLFNSNNGSTITLPCRIKQIVNMWQGVGRAIYAPPIAGNITCNSSITGLLLVRDGGNITNSTEIFRPEGGNMRDNWRSELYKYKVVEIKPLGIAPTNAKRRVVEREKRAVTLGAMFLGFLGAAGSTMGAASITLTAQARQLLSGIVQQQSNLVRAIEAQQHMLQLTVWGIKQLQARVLAIERYLKDQQLLGIWGCSGKLICTTAVPWNSSWSSKTEKDIWENMTWMQWDREISNYTDIIYNLLEVSQIQQEQNEKDLLALDSWKNLWNWFDISKWLWYIKIFIMIVGGLIGLRIIFAVLSIVNRVRQGYSPLSFQTLIPNPRELDRLGRIEEEGGEQDRDRSIRLVRGFLALAWDDLRSLCLFSYHRLRDFILIAARAAELLGHSSLRGLQRGWEILKYLGSLAQYWGLELKKSAISLLDITAIAVAEGTDRIIELIQRIWRAIRNIPTRIRQGFETALL

SEQ ID NO: 133 - protein, 853 aa, Artificial Sequence
  Description of Artificial Sequence: TV006c9.2
MRVRGILRNYPQWWIWVILGFWIIYNVGGNMWVTVYYGVPVWKDAKTTLFCASDAKAYDKEVHNVWATHACVPTDPNPQELVLENVTENFNMWKNDMVDQMHEDIISLWDESLKPCVKLTPLCVTLNCTDNVTVNTTSLTVSPTVNITEQIRNCSFNITTELRDKKKQVYALFYRLDIVQFDNDNSSYRLINCNTSAITQACPKVTFDPIPIHYCAPAGYAILKCNNKTFNGTGPCSNVSTVQCTHGIKPVVSTQLLLNGSLAEGDIIIRSQNLTNNAKIIIVHLNESVEIVCTRPGNNTRQSIRIGPGQTFYATGDIIGDIRQAHCNISAGKWNETLKRVSKKLGEHFPNKTIKFAPHSGGDLEITMHSFNCRGEFFYCNTSSLFNSSYNTSGLFNSNNGSTITLPCRIKQIVNMWQGVGRAIYAPPIAGNITCNSSITGLLLVRDGGNTTNSTETFRPEGGNMRDNWRSELYKYKVVEIKPLGIAPTNAKRRVVEREKRAVTLGAMFLGFLGAAGSTMGAASIALTAQARRLLSGIVQQQSNLLKAIEAQQHMLQLTVWGIKQLQARVLAIERYLKDQQLLGIWGCSGKLICTTAVPWNSSWSDKTEKDIWENMTWMQWDREISNYTDIIYNLLEVSQIQQEQNEKDLLALDSWKSLWNWFDISKWLWYIKIFIMIVGGLIGLRIIFAVLSIVNRVRQGYSPLSFQTLIPNPRELDRLGRIEEEGGEQDRDRSIRLVQGFLALAWDDLRSLCLFSYHRLRNFILIAARAAELLGHSSLRGLQRGWEILKYLGSLAQYWGLELKRSAISLLDITAIAVAEGTDRIIELIQRIWRAIRNIPTRIRQGFEAALQ

SEQ ID NO: 134 - protein, 803 aa, Artificial Sequence
  Description of Artificial Sequence: TV007cB104
MRVRGILRNYQQWWIWASLGFWMLMSYNVVGNLWVTVYYGVPVWKEAKTTLFCASDAKGYEKEVHNVWATHACVPTDPNPQELVVENVTENFNMWKNDMVDQMHEDIISLWDQSLKPCVKLTPLCVTLRCVNVNATSNATSSSSATSDNPMNGEIKNCSFNVTTEIRDRKKEVYALFYKPDVVSLDNSSTYRLINCNTSTLTQACPKVTFDPIPIHYCAPAGYAILKCNNKTFNGTGPCTNVSTVQCTHGIKPVVSTQLLLNGSLAEKEIIIKSKNLTNNAQTIIVHLNESIEIRCPRPNHNTRRSIRIGPGQAFYATGDIIGDIRQAHCNISESKWNKTLQRVSKKLGEHFPNKTIKFAPHSGGDLEITTHSFNCRGEFFYCNTSKLFNSTYMPNVTESNGTESNVTMITLPCRIKQIINMWQEVGRAMYAPPIAGNITCTSNITGLLLVRDGGTEDNTTEIFRPGGGDMRDNWRNELYKYKVVEIKPLGIAPTTAKRRVAEREKRAAGLGAVLLGFLGAAGSTMGAASITLTVQARQLLSGIVQQQSNLLKAIEAQQHVLQLTVWGIKQLQTRVLAIERYLKDQQLLGIWGCSGKLICTTAVPWNSSWSNRSQTDIWNNMTWMQWDREISNYTDTIYKLLEESQNQQENNEKDLLALNSWQNLWSWFNITNWLWYIRIFIMIVGGLIGLRIIFAVISIVNRVRQGYSPLLSQTLTPNPRGPDRLGRIEEEGGEQDKDRSIRLVSGFLSLAWDDLRSLCLFSYHRLRDLILIVVRAVELLGRSSLRGLQRGWEALKYLGGLV

SEQ ID NO: 135 - protein, 803 aa, Artificial Sequence
  Description of Artificial Sequence: TV007cB105
MRVRGILRNYQQWWIWASLGFWMLMSYNVVGNLWVTVYYGVPVWKEAKTTLFCASDAKGYEKEVHNVWATHACVPTDPNPQELVVENVTENFNMWKNDMVDQMHEDIISLWDQSLKPCVKLTPLCVTLRCVNVNATSNATSSSSATSDNPMNGEIKNCSFNVTTEIRDRKKEVYALFYKPDVVSLDNSSTYRLINCNTSTLTQACPKVTFDPIPIHYCAPAGYAILKCNNKTFNGTGPCTNVSTVQCTHGIKPVVSTQLLLNGSLAEKEIIIKSKNLTNNAQTIIVHLNESIEIRCPRPNHNTRRSIRIGPGQAFYATGDIIGDIRQAHCNISESKWNKTLQRVSKKLGEHFPNKTIKFAPHSGGDLEITTHSFNCRGEFFYCNTSKLFNSTYMPNVTESNGTESNVTMITLPCRIKQIINMWQEVGRAMYAPPIAGNITCTSNITGLLLVRDGGNNTNTTEIFRPGGGDMRDNWRNELYKYKVVEIKPLGIAPTTAKRRVAEREKRAAGLGAVLLGFLGAAGSTMGAASITLTVQARQLLSGIVQQQSNLLKAIEAQQHVLQLTVWGIKQLQTRVLAIERYLKDQQLLGIWGCSGKLICTTAVPWNSSWSNRSQTDIWNNMTWMQWDREISNYTDTIYKLLEESQNQQENNEKDLLALNSWQNLWSWFNITNWLWYIRIFIMIVGGLIGLRIIFAVISIVNRVRQGYSPLLSQTLTPNPRGPDRLGRIEEEGGEQDKDRSIRLVSGFLSLAWDDLRSLCLFSYHRLRDLILIVVRAVELLGRSSLRGLQRGWEALKYLGGLV

SEQ ID NO: 136 - protein, 854 aa, Artificial Sequence
  Description of Artificial Sequence: TV010cD7
MRVMGILRNCQQWWMWGILGFWMICNVVGNLWVTVYYGVPVWKEAKTTLFCASDAKGYEKEVHNVWATHACVPTDPNPQELVLENVTENFNMWKNDMVDQMHEDIISLWDQSLKAMCKVDPTLCHFKLYKCYYLTGNGTHSHSYTIGDEIKNCSFNTTTVLKDKTQKVHALFYKLDVVPLNGSNSSEYRLINCNTSTITQACPKVSFDPIPIHYCAPAGYAILKCNNKTFNGTGPCQNVSTVQCTHGIKPVVSTQLLINGSLAEGEIMIRSENLTNNAKTIIVHFNQSIEIVCTRPNNNTRKSVRIGPGQTFYATGDIIGDIREAHCNISKEKWNNTLQEVSKKLKEHYPNKTITFKPHSGGDPEITTHSFICSGEFFYCNTSGLFNGTYMPNGTDKSNDTSPITLPCRIKQIINMWQGVGRAMYAPPIAGNITCKSNITGLLLTRDGGENNRTNETFRPGGGDMRDNWRSELYKYKVVEIKPLGIAPTTAKRRVVEREKRAVGIGAMFLGFLGMAGSTMGAASITLTVQARQLLSGIVQQQSKLLRAIEAQQHMLQLTVWGIKQLQARVLAIKRYLKDQQLLGLWGCSGKLICTTAVPWNSSWSNNKSQTEIWDNMTWMQWDREISNYSNTIYRLLEESQNQQEKNEKDLLALDSWNNLWNWFSITKWLWYIRIFIIIVGGLIGLRIIFAVISIANRVRQGYSPLSLQTLIPDPRGPDRPGRIEEEGGEQDRDRSIRLVSGFLALAWDDLRSLCLFCYHRLRDFILIAARVVELLGRSSLRGLQRGWEALKYLGSLVQYWGLELKKSAISLLDTIAIATAEGTDRIIELIQGIGRAIYNIPRRIRQGFEAALQ

SEQ ID NO: 137 - protein, 859 aa, Artificial Sequence
  Description of Artificial Sequence: TV018cF1027
MRVMGIKRNCQQWWIWGILGFWVLMICNVMGNLWVTVYYGVPVWREAKTTLFWASDAKAYEKEVHNVWATHACVPTDPNPQEIVLENVTENFNMWENNMVDQMHEDIISLWDQSLKPCVKLTPLCVTLNCRNVTVTTNNDNNVTYNNSIPEEIKNCSFNITTEIRDKKKIEYALFYRLGIVPLKENKLNSSEYRLINCNTSAITQACPKVSFDPIPIHYCAPAGYAILKCNNKTFNGTGPCNNVSTVQCTHGIKPVVSTQLLLNGSLAEEEIIIRSKNMTNNVKTIIVHLNESVEIVCTRPNNNTRRSMRIRPGQTFYATGEIIGDIRQAYCKISEDQWNKTLRRVSEKLREHFPDKTIKFEPPSGGDLEITTHSFNCRGEFFYCNTSELFNSTYMPNGTESNTSKTIILPCRIKQIINMWQGVGRAMYAPPIAGNITCQSNITGILLTRDGGEESKSNGTEIFRPAGGDMKDNWRSELYRYKVVEIKPLGVAPTEAKRRVVEREKRAVGIGAVFLGFLGAAGSTMGAASITLTVQARQPFSGIVQQQSNLLRAIEAQQHMLQLTVWGIKQLQTRVLAVERYLKDQQLLGLWGCSGKLICTTAVPWNSSWSNKSQTDIWDNMTWMQWDREISNYTETIYKLLEDSQNQQEQNEKDLLALDSWKNLWNWFDITKWLWYIKIFIMIVGGLIGLRIIFAVLSIINRVRQGYSPLSLQTLTPNPRGPDRLGRIEEEGGEQDRDRSVRLVNGFLALVWDDLRSLCLFSYHQLRDLILIVARAVEVLGRNSLRGLQTGWEALKYLGNLVLYWGLELKRSAISLLDTTAIVVAEGTDRIFEAICRICRAIRNIPRRIRRGFEAALL

SEQ ID NO: 138 - protein, 857 aa, Artificial Sequence
  Description of Artificial Sequence: TV014c6.3
QGVRGIQRNWQQWWIWGILGFWMLMICNVLGNLWVTVYYGVPVWKEAITTLFCASNAKAYEREVHNVWATHACVPTDPNPQEIVLGNVTENFNMWKNDMVDQMHEDIISLWDQSLKPCVKLTPLCVTLECTGVKATNNSSATNSSNVTNNDEIKNCSFNATTEIKDKKHKEYALFYRLDIVPLNNGNPSEGNSSEKYRLINCNTSTLTQACPKVSFDPIPIHYCTPAGYAILKCNNKTFNGTGPCHNVSTVQCTHGIKPVVSTQLLLNGSLAEEEIIIRSENLTNNAKIIIVQLNKSVEIVCTRPGNNTRKSVRIGPGQTFYATGDIIGDIRQAHCNITEDKWNETLQWVGKKLGELFPNKTIEFKPSSGGDLEITTHSFNCRGEFFYCNTSQLFNSTYNSTQMHNDTGSNSTITLPCKIKQIINMWQGVGRAMYAPPIAGNITCKSNITGILLVRDGGNTNDTNGTGIFRPGGGDMKDNWRSELYKYKVVEIKPLGIAPTEAKRRVVEREKGAVGIGAVLLGFLGAAGSTMGAASITLTVQARQLLSGIVQQQSNLLRAIEAQQHMLQLTVWGIKQLQARVLAIERYLQDQQLLGLWGCSGKLICTTTVPWNSSWSNKSLTDIWDNMTWMQWDREINNYTTTIYQLLEKSQIQQEQNEKDLLALDKWQNLWNWFSITQWLWYIKIFIMIVGGLIGLRIIFAVLSIVNRVRQGYSPLSFQTLTPNPRGPDRLGRIEEEGGEQDRERSIRLVSGFFSLAWDDLRNLCLFSYHRLRDFILIATRVVELLGRRGWETLKYLGSLGQYWGLELKKSAISLLDAIAIAVAEGTDRIIEFIQRICRAIRNTPRRIRHGFAALQ

SEQ ID NO: 139 - protein, 861 aa, Artificial Sequence
  Description of Artificial Sequence: TV014c6.4
MRVRGIQRNWQQWWIWGILGFWMLMICNVLGNLWVTVYYGVPVWKEAKTTLFCASDAKAYEREVHNVWATHACVPTDPNPQEIVLGNVTENFNMWKNDMVDQMHEDIISLWDQSLKPCVKLTPLCVTLECTGVKATNNSSNGTATNSSNVTNKDEIKNCSFNATTEIKDKKHKEYALFYRLDIVPLNNGNPSEGNSSEKYRLTNCNTSTLTQACPKVSFDPIPIHYCTPAGYAILKCNNKTFNGTGPCHNVSTVQCTHGIKPVVSTQLLLNGSLAEEEIIIRSENLTNNAKIIIVQLNKSVEIVCTRPGNNTRKSVRIGPGQTFYATGDIIGDIRQAHCNITEDKWNETLQWVGKKLGELFPNKTIEFKPSSGGDLEITTHSFNCRGEFFYCNTSQLFNSTYNSTQMHNDTGSNSTITLPCKIKQIINMWQGVGRAMYAPPIAGNITCKSNITGILLVRDGGNTNDTNGTEIFRPGGGDMKDNWRSELYKYKVVEIKPLGIAPTEAKRRVVEREKRAVGIGAVLLGFLGAAGSTMGAASITLTVQARQLLSGIVQQQSNLLRAIEAQQYMLQLTVWGIKQLQARVLAIERYLQDQQLLGLWGCSGKLICTTTVPWNSSWSNKSLTDIWDNMTWMQWDREINNYTTTIYQLLEKSQIQQEQNEKDLLALDKWQNLWNWFSITQWLWYIKIFIMIVGGLIGLRIIFAVLSIVNRVRQGYSPLSFQTLTPNPRGPDRLGRIEEEGGEQDRERSIRLVSGFFSLAWDDLRNLCLFSYHRLRDFILIVTRVVELLGRRGWETLKYLGSLGQYWGLELKRSAISLLDAIAIAVVEGTDRIIEFIQRICRAIRNTPRRIRQGFEAALQ

SEQ ID NO: 140 - protein, 865 aa, Artificial Sequence
  Description of Artificial Sequence: TV008c4.3
MRVMGILRNCPQWWIWGILSFWMLMICNVGGKLWVTVYYGVPVWKEAKTTLFCASDAKAYEREVHNVWATHACVPTDPNPQEIVLENVTENFNMWKNDMVDQMHEDIISLWDQSLKPCVKLTPLCVTLNCSDVIPSNVTNTTVTHNNITDKEEMRNCTFNITTEITDKKSKEYAIFYRLDVVPLNEKDNKSTECRLINCNTSTVTQACPKVSFEPIPIHYCAPAGYAILKCNNKTFNGTGPCNNVSTIQCTHGIKPVVSTQLLLNGSLAEKEIIIRSENLTDNAKTIIVHLNESIRIMCTRPNNNTRKSIRIGPGQTFFATNDIIGDIRQAYCNISKDDWNKTLQRIAEKLGKHFPNKNITFRPSSGGDLEITTHSFNCRGEFFYCNTSRLFNHTYLFNGTGVPNNTTPSNETIILPCRIKQIINMWQEVGRAMYAPPIAGNITCTSNITGLLLVRDGGNSGKNTTEEIFRPGGGNMKDNWRSELYKYKVVEIKPLGIAPTAAKRRVVEREKRAVGIGAVFLGFLGAAGSTMGAASITLTVQARQLLSGIVQQQSNLLRAIEAQQHLLQLTVWGIKQLQTRVLAMERYLRDQQLLGIWGCSGKLICTTNVPWNASWSNKSLGDIWDNMTWMQWDREINNYTNTIYRLLEESQTQQEQNEKDLLALDKWQNLWSWFNITNWLWYIKIFIMIVGGLIGLRIIFAVLSIVNRVRQGYSPLSFQTLIPDPRGPDRLRRIEEEGGEQDKDRSVRLVSGFLALAWDDLRSLCLFSYHLLRDFILGVARVVELLGRSSLRKLQRGWEALKYLGSLVQYWGLELEKSAISLLDTIAITVAGGTDRIIEFLQRICRAIRNLPRRIRHGFEAALQ

SEQ ID NO: 141 - protein, 862 aa, Artificial Sequence
  Description of Artificial Sequence: TV008c4.4
MRVMGILRNCPQWWIWGILSFWMLMICNVGGKLWVTVYYGVPVWKEAKTTLFCASDAKAYEREVHNVWATHACVPTDPNPQEIVLENVTENFNMWKNDMVDQMHEDIISLWDQSLKPCVKLTPLCVTLNCSDVIPSNVTVTHNNIMDKEEMRNCSFNITTEITDKKSKEYAIFYRLDVVPLNEKDNKSTEYRLINCNTSTVTQACPKVSFEPIPIHYCAPAGYAILKCNNKTFNGTGPCNNVSTIQCTHGIKPVVSTQLLLNGSIAEEGIIIRSENLTDNAKTIIVHLNESIRIVCTRPNNNTRKSIRIGPGQTFFATNDIIGDIRQAYCNISKDDWNKTLQRVAEKLGKHFPNKNITFRPSSGGDLEITTHSFNCRGEFFYCNTSRLFNHTYLFNGTGMPNSTTPSNETIILPCRIKQIINMWQEVGRAMYAPPTAGNITCTSNITGLLLVRDGGNSGNNTTEEIFRPGGGNMRDNWRSELYKYKVVEIKPLGIAPTAAKRRVVEREKRAVGIGAVFLGFLGAAGSTMGAASITLTVQARQLLSGIVQQQSNLLRAIEAQQHLLQLTVWGIKQLQTRVLAMERYLKDQQLLGIWGCSGKLICTTNVPWNTSWSNKSLSDIWDNMTWIQWDREINNYTSTIYRLLEESQTQQEQNEKDLLALDKWQNLWSWFNITNWLWYIKIFIMIVGGLIGLRIIFAVLSIVNRVRQGYSPLSFQTLIPDPRGPDRLRRIEEEGGEQDKDRSVRLVSGFLALAWDDLRCLCLFSYHLLRDFILGVARVVELLGRSSLRKLQRGWEALKYLGSLVQYWGLELKKSAISLLDTIAITVAGGTDRIIEFLQRICRAIRNLPRRIRQGFEAALQ

SEQ ID NO: 142 - protein, 862 aa, Artificial Sequence
  Description of Artificial Sequence: TV019c5
MRVQGILRNCQQWWTWGILGFWIIMTCNVVGNLWVTVYYGVPVWKEAKTTLFCASDAKAYEKEVHNVWATHACVPTDPNPQEIVLENVTENFNMWKNDMVDQMHEDVISLWDQSLKPCVKLTPLCVTLNCTDVDKNSTEMYRKTTNDNGNDTIDREMKNCSFNATTDIQDKKTGVYALFYRLDIVPLNDTNNSREYRLINCNTSTMTQACPKVSFDPIPIHYCTPAGYAILKCNNKTFSGTGPCNNVSTVQCTHGIKPVVSTQLLLNGSLAEKEIIIRSKNLTDNAKTIIVHLNESIAIMCTRPGNNTRKSIRIGPGQAFFATGAIIGDIRKAYCNISEGEWNRTLQRVGRKLAEHFPGKRIRFAPPSGGDLEITTHSFNCGGEFFYCNTTQLFNRTYNTTQLFNGTYSSNDTESNFTLPCRIKQIINMWQEVGRAMYAPPIKGNITCNSNITGLLLVRDGGEDNNTENDTETFRPGGGDMRDNWRSELYKYKVVEIKPLGIAPTGAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNRTEGDIWNNLLWMQWDREISNYSDTIYRLLEASQNQQEQNEKDLLALSNWQNLWSWFNISNWLWYIRIFIMIVGGLIGLRIIFAVLSLVNKVRQGYSPLSLQTLTPNPRGPDRLRGIEEEGGEQDRDRSVRLVSGFLALAWDDLRSLCLFSYHQLRDFILIVARAVEILGRRGWEALKYLGSLVQYWGLELKKSAINLLDTIAIAVAEGTDRIIELILGLGRAICNIPRRIRQGFEAALQ

SEQ ID NO: 143 - protein, 845 aa, Artificial Sequence
  Description of Artificial Sequence: TV003cE260
MRVRGILRNWQQWWIWGILGFWMLMIYSVLGNLWVTVYYGVPVWKEAKTTLFCASDAKAYEREVHNVWATHACVPTDPNPQEMVLGNVTENFNMWKNDMVDQMHEDIISLWDQSLKPCVKLTPLCVTLECNNVNTTNEMTNCSFNATTDVRDKKQRVSAFFYRLDIVPLNENNNESQKYRLISCNTSTITQACPKVTFDPIPIHYCTPAGYAILKCNNKTFNGTGPCHNVSTVQCTHGIKPVVSTQLLLNGSLAEEEIIIRSENLTNNAKIIIVHLNESVEIVCTRPNNNTRKSIRIGPGQTFYATNGIIGNIRQAHCNISEERWNKTLQQVGKKLAEHFPNKTIKFEPSSGGDLEITTHSFNCGGEFFYCNTSGLFNGTYNHTTEGNSNSTITLPCRIKQIINMWREVGRAMYAPPIAGNITCKSNITGLLLVRDGGESNDSDNNIEIFRPGGGDMRNNRRSELYKYKVVEIKPLGIAPTGAKRRVVEREKRAVGLGAMFLGFLGAAGSTMGAASITLTVQARQLLSGIVQQQSNLLKAIEAQQHMLQLTVWGIKQLQTRVLAIERYLKDQQLLGLWGCSGKLICTTAVPWNSSWSNKSVTDIWDNMTWMQWDREISNYTNTIYRLLEDSQTQQEQNEKDLLALDSWNNLWNWFNITKWLWYIKIFIMMVGGLIGLRIIFAVLSVVNRVRQGYSPLSFQTLIPSPRGPDRLGRIEEEGGEQDRDRSVRLVNGFLAIAWDDLRSLCLFSYHRLRDFILIATRAVELLGRSSLRGLQRGWEALKYLGSLVQYWGLELKKSAVSLLDTVAIVVAEGTDRIIELVQRVCRAIRNIPTRIRQGFETALL

SEQ ID NO: 144 - protein, 855 aa, Artificial Sequence
  Description of Artificial Sequence: TV004cC300
MRVREIPRNWQQWWIWGILGFWMVMICNVMGNLWVTVYYGVPVWKEAKTTLFCASDAKAYENEVHNVWATHACVPTDPNPQEIVLENVTENFNMWKNDMVDQMHEDIISLWDQSLQPCVKLTPLCVTLNCTTVTNSTVNNTRGEMRNCSFNMTTEVRDKKQQVYALFYKLDVVPLNENNSDSSNFSEYRLINCNTSAMTQACPKVTFDPIPIHYCAPAGYAILKCNNKTFNGTGPCSNVSTVQCTHGIKPVVSTQLLLNGSLAEKEIIIRSENLTNNVKTIIVHLNESIEIRCTRPNNNTRKSIRIGPGQTFYATGEIIGDIRQAHCTISSQNWNRTLQRVSEKLKEHFPNKTIKFEPSSGGDLEITTHSFNCRGEFFYCNTSGLFNRTFNSTYMHNSTNNDSIITIPCRIKQIINMWQEVGRAMYAPPVAGNITCKSNITGLLLVRDGGENGTNNTEVFRPGGGNMRDNWRSELYKYKVVEIKPLGVAPNKAKRRVVEREKRAVGIGAVFLGFLGAAGSTMGAASIALTAQARQVLSGIVQQQSNLLKAIEAQQHLLQLTVWGIKQLQTRVLAIERYLKDQQLLGIWGCSGKIICPTAVPWNSSWSNKSQEDIWGNMTWMQWDREISSYTNTIYNLLEESQRQQEKNEKDLLELDSWNFLWSWFDITKWLWYIKIFIIIVGGLIGLRIIFAVLSIVNRVRQGYSPLSFQTLTPSPGGPDRLGRIEEEGGEQDRDRSVRLVNGFLALAWDDLRSLCLFSYHRLRDFILVTARAVELLGRSSLRGLQRGWEALKYLGSLVQYWGLELKKSATSLLDTIAITVAEGTDRIIEIVQRFCRAILHIPRRIRQGFEAALL

SEQ ID NO: 145 - protein, 860 aa, Artificial Sequence
  Description of Artificial Sequence: TV013cH17
MKVREIQRNWPQWWIWGILGLWMIIICSGVGNLWVTVYYGVPVWKEATTTLFCASDAKAYEKEVHNVWATHACVPTDPDPQEIVLENVTEHFNMWKNDMVDQMHEDIISLWDQSLKPCVKLTPLCVTLNCTNAINTNATSTTTTSATATSTIATSTYDNNGEIKNCSFNTTTEIRDKKQNTYALFYRSDIVPLNNRSEYILINCNTSTITQACPKVSFDPIPIHYCAPAGFAILKCNNKTFNGTGPCQNVSTVQCTHGIKPVVSTQLLLNGSLAEEDIRIRSESLENNIKTIIVHLDQSVKIVCTRPNNNTRRSIRIGPGQAFYTNDIIGDIRQAHCNISRAEWNNTLAKVKEKLEKLYNKTIVLEPHSGGDLEITTHSFNCRGEFFYCNTTKLFNITEVQRNVNDTNGTLTLPCRIKQFINMWQEVGRAMYAPPIAGNITCRSNITGLLLTRDGGNITNETETFRPGGGNMKDNWRSELYKYKVVEIRPLGIAPTEAKRRVVEREKRAVGIGAVFLGFLGAAGSTMGAASITLTVQARQLLSGIVQQQSNLLRAIEAQQHLLQLTVWGIKQLQARVLAIERYLKDQQLLGLWGCSGKLICTTAVPWNSSWSNKSQTDIWDNMTWMQWDREISNYTGIIYRLLEDSQTQQEQNEKDLLALDSWKDLWTWFDISKWLWYIRIFIMIVGGLIGLRIILGVLSIVKRVRQGYSPLSFQTLIPNPREPDRLRGIEEEGGEQDKDRSIRLVSGFLALAWDDLRSLRLFSYHQLRDFILIVARAVELLGQSSLRGLQRGWEALKYLGNLVQYWGLELKKSAISLLDTIAIAVAEGTDRIVEIIQRICRAIRNIPRRIRQGFEAALL

SEQ ID NO: 146 - protein, 860 aa, Artificial Sequence
  Description of Artificial Sequence: TV013cB20
MKVREIQRNWPQWWIWGILGFWMIIICSGVGNLWVTVYYGVPVWKEATTTLFCASDAKAYEKEVHNVWATHACVPTDPDPQEIVLENVTEHFNMWKNDMVDQMHEDIISLWDQSLKPCVKLTPLCVTLNCTNAINTNATSTTTTSATATSTIATSTYDNNGEIKNCSFNTTTEIRDKKQNTYALFYRSDIVPLNNRSEYILINCNTSTITQACPKVSFDPIPIHYCAPAGFAILKCNNKTFNGTGPCQNVSTVQCTHGIKPVVSTQLLLNGSLAEEDIRIRSENLENNIKTIVVHLNQSVKIVCTRPNNNTRRSIRIGPGQAFYTNDIIGDIRQAHCNISRAEWNNTLAKVKEKLEKLYNKTIVFEPHSGGDLEITTHSFNCRGEFFYCNTTKLFNITEVQRMVNDTNGTLTLPCRIKQFINMWQEVGRAMYAPPIAGNITCRSNITGLLLTRDGGNITNETETSRPGGGNMKDNWRSELYKYKVVEIKPLGIAPTEAKRRVVEREKRAVGIGAVFLGFLGAAGSTMGAASITLTVQARQLLSGIVQQQSNLLRAIEAQQHLLQLTVWGIKQLQARVLAIERYLKDQQLLGLWGCSGKLICTTAVPWNSSWSNKSQTDIWDNMTWMQWDRKISNYTGIIYRLLEDSQTQQEQNEKDLLALDSWKNLWTWFDISKWLWYIRIFIMMVGGLIGLRIILGVLSIVKRVRQGYSPLSFQTLIPNPREPDRLRGIEEEGGEQDKDRSIRLVSGFLALAWDDLRSLCLFSYHQLRDFILIVARAVELLGQSSLRGLQRGWEALKYLGNLVQYWGLELKKSAISLLDTIAIAVAEGTDRIIEIIQRICRAIRNIPRRIRQGFEAALL

SEQ ID NO: 147 - protein, 870 aa, Artificial Sequence
  Description of Artificial Sequence: IN21068
MRVRGILRNYQQWWIWGVLGFWMLMICNVVGNLWVTVYYGVPVWKEANTTLFCASDAKAYEKEVHNVWATHACVPTDPNPQEIVMENVTENFNMWKNDMVNQMHEDVISLWDQSLKPCVKLTPLCVTLECRNVNSTGNGTHSKTYNESMKEIKNCSFNATTVIKDKKQTVYALFYKLDIVPLDNEEQENDSNSSGYYRLINCNTSALTQACPKVTFDPIPIHYCAPAGYAILKCNNKTFNGTGPCHNVSTVQCTHGIKPVVSTQLLLNGSLAEGGIIIRSENLTNNVKTIIVHLNQPVEIMCTRPDNNTRKSIRIGPGQTFYATGDIIGDIRQAHCNISEDKWNETLQNVSKKLAEHFPNKTIIFNSSSGGDLEITTHSFNCRGEFFYCNTSGLFNRTYMPNDTKSNSSSNPNANITIPCRIKQIINMWQEVGRAMYAPPIEGKITCRSNITGLLLVRDGGEDKNNTETNKTETFRPGGGDMRDNWRSELYKYKVVEVKPLGVAPTTAKRRVVEREKRAVGIGAVFLGFLGAAGSTMGAASITLTVQARQLLSGIVQQQSNLLRAIEAQQHLLQLTVWGIKQLQTRVLAIERYLKDQQLLGIWGCSGKLICTTAVPWNSSWSNRTQKEIWDNMTWMQWDREINNYTNTIYRLLEESQNQQEENEKDLLALDSWKNLWNWFDITKWLWYIKIFIIIVGGLIGLRIIFAVISIVNRVRQGYSPLSFQTLTPNPGGPDRLGRIEEEGGEQDKDRSIRLVSGFLALFWDDLRNLCLFSYHRLRDFILVAARVLELLGRRSLRGLQRGWEALKYLGSLVQYWGLELKKSAINLLDRIAIAVAEGTDRILELVQRICRAIRNIPRRIRQGFEAALQ

SEQ ID NO: 148 - protein, 849 aa, Artificial Sequence
  Description of Artificial Sequence: 96BW05.02
MRVMGILKNYQQWWMWGILGFWMLIISSVVGNLWVTVYYGVPVWKEAKTTLFCTSDAKAYETEVHNVWATHACVPTDPNPQEIVLENVTENFNMWKNDMVDQMHEDIISLWDQSLKPCVKLTPLCVTLKCRNVNATNNINSMIDNSNKGEMKNCSFNVTTELRDRKQEVHALFYRLDVVPLQGNNSNEYRLINCNTSAITQACPKVSFDPIPIHYCTPAGYAILKCNNQTFNGTGPCNNVSSVQCAHGIKPVVSTQLLLNGSVAKGEIIIRSENLTNNAKIIIVQLNKPVKIVCVRPNNNTRKSVRIGPGQTFYATGEIIGDIRQAYCIINKTEWNSTLQGVSKKLEEHFSKKAIKCEPSSGGDLEITTHSFNCRGEFFYCDTSQLFNSTYSPSFNGTENKLNGTITITCRIKQIINMWQKVGRAMYAPPIAGNLTCESDITGLLLTRDGGKTGPNDTEIFRPGGGDMRDNWRNELYKYKVVEIKPLGVAPTEAKRRVVEREKRAVGIGAVCLGFLGAAGSTMGAASITLTVQARLLLSGIVQQQNNLLRAIEAQQHLLQLTVWGIKQLQTRILAVERYLKDQQLLGIWGCSGKLICTTAVPWNSSWSNRSHDEIWDNMTWMQWDREINNYTDTIYRLLEESQNQQEKNEKDLLALDSWQNLWNWFSITNWLWYIKIFIMIVGGLIGLRIIFAVLSIVNRVRQGYSPLPFQTLTPNPREPDRLGRIEEEGGEQDRGRSIRLVSGFLALAWDDLRSLCLFSYHRLRDFILIAARVLELLGQRGWEALKYLGSLVQYWGLELKKSAISLLDTIAIAVAEGTDRIIEFIQRICRAIRNIPRRIRQGFEAALQ

SEQ ID NO: 149 - protein, 851 aa, Artificial Sequence
  Description of Artificial Sequence: ETH2220
MKVMGIQRNCQQWWIWGILGFWMLMICNGMGNLWVTVYYGVPVWKDASPTLFCASDAKAYDTEVHNVWGTFACVPTDPSPQELGLENVTENFNMWKNDMVEQMHQDIISLWDQGLKPCVKLTPLCVTLNCNAIKNNTKVTNNSINSANDEMKNCSFNITTELRDKKRKAYALFYKLDIVPLNNGSTDYRLINCNTSTITQACPKVSLDPIPIHYCAPAGYAILKCRDKTFTGTGPCHNVSTVQCTHGIKPVVSTQLLLNGSIAEGETIIRFENLTNNAKIIIVQLNESVEITCTRPSNNTRESIRIGPGQTFYATGDIIGDIRQAHCNISEEKWNKTLQKVKEKLQKHFPNKTIEFKPSSGGDLEITTHSFNCGGEFFYCNTSNLFNSTKLELFNSSTNLNITLQCRIKQIINMWQGVGRAMYAPPIEGIIMCRSNITGLLLTRDGAKEPHSTKEIFRPEGGDMRDNWRSELYKYKVVEIKPLGVAPTKPKRRVVEREKRAALGALFLGFLGAAGSTMGAASITLTVQARQLLSGIVQQQSNLLKAIEAQQHMLQLTVWGIKQLQTRVLAIERHLRDQQLLGIWGCSGKLICTTAVPWNSSWSNKSQEEIWDNMTWMQWDREISNYTDIIYNLLEVSQNQQDKNEKDLLALDKWENLWNWFNITNWLWYIKIFIMIVGGVIGLRIIFAVLSIVNRVRQGYSPLSFQTLIPHPRGPDRLGGIEEEGGEQGRDRSIRLVNGFLAIFWDDLRSLCLFSYHRLRDLILIAARTVELLGRSSLKGLQRGWETLKYLGSLVQYWGLELKKSAINLLNTTAIVVGEGTDRFIELIQRIWRAFCNIPRRIRQGLEAALQ

SEQ ID NO: 150 - protein, 858 aa, Artificial Sequence
  Description of Artificial Sequence: 92BR025.8
MRVEGIQRNWKQWWIWGILGFWMVMIYNVRGNLWVTVYYGVPVWKEAKTTLFCASDAKAYDAEVHNVWATHACVPTDPNPQEMVLENVTENFNMWENDMVEQMHQDIISLWDQSLKPCVKLTPLCVTLHCSNRTIDYNNRTDNMGGEIKNCSFNMTTEVRDKREKVHALFYRLDIVPLKNESSNTSGDYRLINCNTSAITQACPKVSFDPIPIHYCAPAGYAILKCNNKTFNGTGPCNNVSTIQCTHGTKPVVSTQLLLNGSLAEEEIIIRSKNLTDNVKTIIVHLNESVEINCTRPNNNTRKSIRIGPGQAFYATGEIIGDIRQAHCNISRTAWNKTLQEVGKKLAEHFPNKAIKFAKHSGGDLEITTHSFNCRGEFFYCNTSSLFNSTYTPNSTENITGTENSIITIPCRIKQIINMWQGVGRAMYAPPIEGILTCRSNITGLLLTRDGGTGMETHDTEIFRPEGGDMRDNWRSELYKYKVVEIKPLGIAPTKAKRRVVEREKRAVGIGAVFLGFLGAAGSTMGAASITLTVQVRQLLSGIVQQQSNLLRAIEAQQHMLQLTVWGIKQLQTRVLAIERYLRDQQLLGIWGCSGKLICTTAVPWNSSWSNRSQEDIWNNMTWMQWDREISNYTNTIYRLLEDSQNQQEKNEQDLLALDKWQNLWTWFGITNWLWYIKIFIKIVGGLIGLRIIFAVLSIVNRVRQGYSPLSFQTLTPNPRGPDRLGGIEEEGGEQDRDRSIRLVSGFLALAWDDLRSLCLFSYHRLRDLILIAARAVELLGRSSLRGIQRGWEILKYLGGLVQYWSLELKKSAISLFDTIAIAVAEGTDRIIEVIQGIWRAICNIPRRIRQGFEAALQ

SEQ ID NO: 151 - protein, 192 aa, Artificial Sequence
  Description of Artificial Sequence: Vif TV007-6
MENRWQVLIVWQVDRMRIRTWNSLVKHHMYISRRANGWLYRHHYENRHPKVSSEVHIPLGEARLVIKTYWGLQTGERDWHLGQGVSIEWRLRRYSTQVDPGLADQLIHMHYFDCFADSAIRKAILGHIVIPRCDYPAGHNKVGSLQYLALTALIKPKKIKPPLPSVKKLVEDRWNKPQKTRGRRGNHTMNGH

SEQ ID NO: 152 - protein, 192 aa, Artificial Sequence; identical to SEQ ID NO: 151
  Description of Artificial Sequence: Vif TV007-2

SEQ ID NO: 153 - protein, 192 aa, Artificial Sequence
  Description of Artificial Sequence: Vif TV019-82
MENRWQVLIVWQVDRMKIRTWNSLVKHHMYISRKARGWFYRHHFESRHPKVSSEVHIPLGEARLVIKTYWGLQTGEREWHLGHGASIEWRLRKYSTQVDPGLADQLIHMHYFDCFADSAIRKAILGHIVIPRCDYQAGHNKVGSLQYLALTALVKPKKIKPPLPSVQKLVEDRWNNPQKTRGRRGNHTMNGH

SEQ ID NO: 154 - protein, 192 aa, Artificial Sequence
  Description of Artificial Sequence: Vif TV019-85
MENRWQVLIVWQVDRMKIRTWNSLVKHHMYISRKASGWFYRHHFESRYPKVSSEVHIPLGEARLVIKTYWGLQTGEREWHLGHGVSIEWRLRKYSTQVDPGLADQLIHMHYFDCFADSAIRKAILGHIVIPRCDYQAGHNKVGSLQYLALTALVKPKKIKPPLPSVQKLVEDRWNNPQKTRGRRGNHTMNGH

SEQ ID NO: 155 - protein, 192 aa, Artificial Sequence
  Description of Artificial Sequence: Vif TV008-17
MENRWQVLIVWQVDRMRIRTWNSLVKHHMYISKRASRWFYRHHYESRHPKVSSEVHIPLGEARLIIKTYWGLQTGERDWHLGHGCSIEWRLRRYSTQVDPGLADQLIHMHYFDCFAESAIRKAILGHIVVPRCDYQAGHNKVGSLQYLALTALIKPKRRKPPLPSVRKLAEDRWNKPQKTRDHRGNHTMNGH

SEQ ID NO: 156 - protein, 192 aa, Artificial Sequence
  Description of Artificial Sequence: Vif TV008-1
MENRWQVLIVWQVDRMRIRTWNSLVKHHMYISKRASRWFYRHHYESRHPKISSEVHIPLGEARLIIKTYWGLQTGERDWHLGHGCSIEWRLRRYSTQVDPGLADQLIHMHYFDCFAESAIRKAILGHIVVPRCDYQAGHNKVGSLQYLALTALIKPKRRKPPLPSVRKLAEDRWNKPQKTRDHRGNHTMNGH

SEQ ID NO: 157 - protein, 192 aa, Artificial Sequence
  Description of Artificial Sequence: Vif TV014-25
MENRWQVLIVWQVDRMRIRTWNSLVKHHMYVSRRATGWLYRHHYESRHPRISSEVHIPLGDAKLIIKTYWGLQTGERDWHLGHGCSIEWRLRRYSTQVDPGLADQLIHMHYFDCFAESAIRKAILGHIVIPRCDYPAGHNKVGSLQYLALTALVKPKKRKPPLPSVRKLAEDRWNSPRKTRDHRGNHTMNGH

SEQ ID NO: 158 - protein, 192 aa, Artificial Sequence
  Description of Artificial Sequence: Vif TV014-31
MENRWQVLIVWQVDRMRIRTWNSLVKHHMYVSRRATGWLYRHHYESRHPRISSEVHIPLGDAKLIVKTYRGLQTGERDWHLGHGCSIEWRLRRYSTQVDPGLADQLIHMHYFDCFAESAIRKAILGHIVIPRCDYPAGHNKVGSLQYLALTALVKPKKRKPPLPSVRKLAEDRWNSPRKTRDHRGNHTMNGH

SEQ ID NO: 159 - protein, 192 aa, Artificial Sequence
  Description of Artificial Sequence: Vif TV004-45
MENRWQVLIVWQVDRMRIRTWNSLVKHHMYISKRASGWFYRHHYESRHPKVSSEVHIPLGEARLIIKTYWSLQTGERDWHLGHGCSIEWRLRRYSTQVDPGLADQLIHMHYFDCFADSAIRQAILGHIVIHRCEYQAGHNKVGSLQYLALTALIKPKRRKPPLPSVRKLVEDRWNKPQKTRGRRGNHTMSGH

SEQ ID NO: 160 - protein, 192 aa, Artificial Sequence
  Description of Artificial Sequence: Vif TV001-2
MENRWQVLIVWQVDRMKIRTWNSLVKHHMYISRRASGWSYKHHFESRHPKVSSEVHIPLGDARLVIKTYWGLQTGERAWHLGQGSSIEWRPERYSTQVDPGLADQLIHMHYFDCFAESAIRQAILGHIVIPRCDYQAGHKKVGSLQYLALTALIKPKKRKPPLPSVRKLVEDRWNNPQKTRGRRGNHTMNGH

SEQ ID NO: 161 - protein, 192 aa, Artificial Sequence
  Description of Artificial Sequence: Vif TV018-8
MENRWQVLVVRQVDRMKIRTWNSLVKHHMYISRRASGWFYRHHYESRHPKVSSEVHIPLGDARLVIKTYWGPLTGERAWHLGHGVSIEWRLRRYSTQVDPGLADQLIHMHYFDCFADSAIRKAILGQVVIHRCDYQAGHNKVGSLQYLALTALIKPKKRKPPLPSVRKLVEDRWNKPQKTRGRRGNHTMNGH

SEQ ID NO: 162 - protein, 192 aa, Artificial Sequence
  Description of Artificial Sequence: Vif TV002-84
MENRWQVLIVRQVDRMKIRTWNSLVKYHMYISRRASGWFYRHHYESRHPKISSEVHIPLGDARLVIKTYWGLLTGERDWHLGHGVSIEWRLKGYSTQVDPGLADQLIHMHYFDCFADSAIRKALLGQVVIHRCDYQAGHNKVGSLQYLALTALIKPKKRKPPLPSVRKLVEDRWNKPQKTRGRRGNHTMNGH

SEQ ID NO: 163 - protein, 192 aa, Artificial Sequence
  Description of Artificial Sequence: Vif TV009-3
MENRWQVLIVWQVDRMKIRTWNSLVKHHMYISKRASGWFYRHHYESRHPKVSSEVHIPLGDARLVIKTYWGPLTGERAWHLGHGVSIEWRLRRYSTHVDPGLADQLIHMHYFDCFADSAIRKAILGHIVIPRCDYQAGHNKVGSLQYLALTALIKPKKRKPPLPSVRKLVEDRWNKSQKTRGRRGNHTMNGH

SEQ ID NO: 164 - protein, 192 aa, Artificial Sequence
  Description of Artificial Sequence: Vif TV013-2
MENRWQVLIVWQVDRMRIRTWNSLVKHHMYISKKASGWFYKHHYESRHPKVSSEVHIPLGEARLIIKTYWGLQTGEREWHLGHGASIEWRLRRYSTQVDPGLADQLIHMHYFDCFADSAIRKAILGHIVIPRCDYPAGHNKVGSLQYLALTALIKPKRIKPPLPSVRKLVEDRWNNPQKTRGRRGNHTMNGH

SEQ ID NO: 165 - protein, 192 aa, Artificial Sequence; identical to SEQ ID NO: 164
  Description of Artificial Sequence: Vif TV013-3

SEQ ID NO: 166 - protein, 192 aa, Artificial Sequence
  Description of Artificial Sequence: Vif TV003-12
MENRWQVLIVWQVDRMRIRTWNSLVKHHMYVSRRASGWFYRHHYESRHPKVSSEVHIPLGKAKLVIKTYWGSQTGEREWHLGHGVSIEWRLGRFSTHVDPGMADQLIHMHYFDCFADSAIRKAILGHIVIPRCDYQAGHNKVGSLQYLALTALIKPKKIKPPLPSIRKLVEDRWNNPQRTRGHRGNHTMNGH

SEQ ID NO: 167 - protein, 192 aa, Artificial Sequence
  Description of Artificial Sequence: Vif TV003-B
MENRWQVLIVWQVDRMRIRAWNSLVKHHMYVSRRASGWFYRHHYESRHPKVSSEVHIPLGKAKLVIKTYWGSQTGEREWHLGHGVSIEWRLGRFSTHVDPGMADQLIHMHYFDCFADSAIRKAILGHIVIPRCDYQAGHNKVGSLQYLALTALIKPKKIKPPLPSIRKLVEDRWNNPQRTRGHRGNHTMNGH

SEQ ID NO: 168 - protein, 192 aa, Artificial Sequence
  Description of Artificial Sequence: Vif TV005-81
MENRWQVLIVWQVDRMRIRTWNSLVKHHMYVSKRTRSWFYRHHYESRHPKVSSEVHIPLGDARLVIKTYWGLQTGEREWHLGHGVSIEWRLRRYSTQVDPNLADQLIHMHYFDCFADSAIRKAILGHRVISRCDYPAGHRQVGSLQYLALTALIKPKKIKPPLPSVRKLVEDRWNNPQKIRGHRGNHTMIGH

SEQ ID NO: 169 - protein, 192 aa, Artificial Sequence
  Description of Artificial Sequence: Vif TV012-4
MENRWQVLIVWQVDRMRIRTWNSLVKHHIYISRRANGWFYRHHYENRHPKISSEVHIPLGDARLVIKTYWGLHTGERDWHLGHGVSIEWKLRKYSTQVDPGLADQLIHVHYFDCFADSAIRQAILGHIVIPRCDYQAGHNKVGSLQYLALTALIKPKKRKPPLPSVRKLVEDRWNKPQKTRDRRGNHTMNGH

SEQ ID NO: 170 - protein, 192 aa, Artificial Sequence
  Description of Artificial Sequence: Vif TV006-9
MENRWQVLIVWQVDRMRIRTWNSLVKHHMYVSKRASGWFYRHHYESRHPRVSSEVHIPLGEAKLVIITYWGLQTGERDWHLGHGVSIEWRLRRYSTQVDPGLADQLIHMYYFDCFADSAIRKAILGHIVIPRCDYQAGHNKVGSLQYLALTALIKPKKRKPPLPSVRKLVEDRWNKSQKTRGRRGNHTMNGH

SEQ ID NO: 171 - protein, 192 aa, Artificial Sequence
  Description of Artificial Sequence: Vif TV010-25
MENRWQVLIVWQVDRMRIRTWNSLVKHHMYISRRAKGWFYRNHYESRHPKVSSEVHIPLGEARLVIKTYWGLQPGERDWHLGHGVSIEWRLRRYSTQVDPGLADQLIHMHYFDCFADSAIRKAILGQIVSPRCNYQAGHNKVGSLQYLALTALIKPRKIKPPLPSVRKLVEDRWNKPQKIRGRRGNHTMNGH

SEQ ID NO: 172 - protein, 192 aa, Artificial Sequence
  Description of Artificial Sequence: Vif 92BR025
MENRWQVLIVWQVDRMKIRTWNSLVKHHMYVSRRASGWYYRHHYESRHPKISSEVHIPLGEARLVIITYWGLQTGERDWHLGHGVSIEWRLRRYSTRVDPGLADQLIHMHYFDCFADSAIRKAILGHRVSSRCDYQAGHNKVGSLQYLALTALIKPKKIKPPLPSVKKLVEDRWNKPQKTRDRRGNHTMNGH

SEQ ID NO: 173 - protein, 192 aa, Artificial Sequence
  Description of Artificial Sequence: Vif 301904-Ind
MENRWQVLIVWQVDRMKIRTWNSLVKHHMYVSRRANGWFYRHHYESRHPKVSSEVHIPLGEATLVIKTYWGLQTGERDWHLGHEVSIEWRLRRYNTQIEPGLADQLIHMHYFDCFTDSAIRKAILGHIVIPRCDYQAGHNKVGSLQYLALTALIKPKKIKPPLPSIKKLVEDRWNNPQKIRGRRGNHTMNGH

SEQ ID NO: 174 - protein, 192 aa, Artificial Sequence
  Description of Artificial Sequence: Vif 301905-Ind
MENRWQVLIVWQVDRMKIRTWNSLVKHHMYVSRRANGWFYRHHYDSRHPKVSSEVHIPLGEARLVIKTYWGLQTGERDWHLGHGVSIEWRLRRYNTQIEPGLADQLIHMHYFDCFADSAIRKAILGHIVIPRCDYQAGHNKVGSLQYLALTALIKPKKIKPPLPSIKKLVEDRWNNPQKIRGRRGNHTMNGH

SEQ ID NO: 175 - protein, 192 aa, Artificial Sequence
  Description of Artificial Sequence: Vif 301999-Ind
MENRWQVLIVWQVDRMKIRTWNSLVKHHMYVSRRATGWFYRHHYESRNPKISSEVHIPLGEARLVIKTYWGLQTGERDWHLGHGVSIEWRLRRYSTQVEPGLADQLIHMHYFDCFADSAIRKAILGHIVIPRCDYQAGHNKVGSLQYLALTALIKPKKIKPPLPSVRKLVEDRWNNPLKTRGRRGNHTMNGH

SEQ ID NO: 176 - protein, 192 aa, Artificial Sequence
  Description of Artificial Sequence: Vif 96BW16-D14
MENRWQVLIVWQVDRMKIKTRNSLVKHHMYISRRAKGWFYRHHYESRNPKVSSEVHIPLGDAKLVIKTYWGLQTGERDWHLGHGVSIEWDLGNYSTQVEPGLADQLIHMHYFDCFTDSAIRKAIVGHTVIHRCNYQAGHNKVGSLQYLALTALIKPKKIKPPLPSVNKLVEDRWNNPQKTRGRRGNHTLNGH

SEQ ID NO: 177 - protein, 192 aa, Artificial Sequence
  Description of Artificial Sequence: Vif 96BW04-09
MENRWQVMIVWQVDRMKIRTWNSLVKHHMYVSKKAKGWFYRHHYESRHPRVSSEVHIPLGDARLVIKTYWGLQTGERDWHLGHGVSIEWRLRGYSTQVDPGLADQLIHMHYFDCFADSAIRKAILGQIVSPRCEYQAGHNKVGSLQYLALTALIKPKKRKPPLPSVRKLVEDRWNEPQKTRGRRGDHTMNGH

SEQ ID NO: 178 - protein, 192 aa, Artificial Sequence
  Description of Artificial Sequence: Vif 96BW12-10
MENRWQGLIVWQVDRMRIRTWHSLIKHHMYVSKRADGWFYRHHYESRHPKVSSEVHIPLGDARLVIITYWGLQTGEREWHLGHGVSIEWRLRSYSTQVDPGLADQLIHMHYFDCFAGSAIRQAILGHIVIPRCDYQAGHKKVGSLQYLALTALIKPKKRKPPLPSVRKLVEDRWNKPQKTRGRKGNHTMNGH

SEQ ID NO: 179 - protein, 192 aa, Artificial Sequence
  Description of Artificial Sequence: Vif C2220-Eth
MENRWQVLIVWQVDRMKIRTWNSLVKHHMHISRRANGWVYRHHYDSRHPKVSSEVHIPLGEARLIIKTYWGLQTGERDWHLGHGVSIEWRLRSYNTQVDPGLADHLIHMHYFDCFAESAIRKAILGYRVSPRCDYQAGHNKVGSLQYLALTALIKPKKAKPPLPSVSKLVEDKWNKPQKTRGRRGNHTMNGH

SEQ ID NO: 180 - protein, 192 aa, Artificial Sequence
  Description of Artificial Sequence: Vif HXB2
MENRWQVMIVWQVDRMRIRTWKSLVKHHMYVSGKARGWFYRHHYESPHPRISSEVHIPLGDARLVITTYWGLHTGERDWHLGQGVSIEWRKKRYSTQVDPELADQLIHLYYFDCFSDSAIRKALLGHIVSPRCEYQAGHNKVGSLQYLALAALITPKKIKPPLPSVTKLTEDRWNKPQKTKGHRGSHTMNGH

SEQ ID NO: 181 - DNA, 5384 bp, Artificial Sequence
  Description of Artificial Sequence: 8_2_TV1
gtcgactgtagtccaggaatatggcaattagattgtacacatttagaaggaaaaatcatcctggtagcagtccatgtagctagtggctacatagaggcagaggttatcccagcagaaacaggacaagaaacagcatattttatattaaaattagcaggaagatggccagtcaaggtaatacatacagacaatggcagtaattttaccagtgctgcagttaaggcagcctgttggtgggcaggtatccaacaggaatttggaattccctacaatccccaaagtcagggagtggtagaatccatgaataaagaattaaagaaaataataggacaagtaagagatcaagctgagcaccttaggacagcagtacaaatggcagtattcattcacaattttaaaagaaaaggggggattggggggtacagtgcaggggaaagaataatagacataatagcaacagacatacaaactaaagaattacaaaaacaaattataaaaattcaaaattttcgggtttattacagagacagcagagaccctatttggaaaggaccagccaaactactctggaaaggtgaaggggcagtagtaatagaagataaaggtgacataaaggtagtaccaaggaggaaagcaaaaatcattagagattatggaaaacagatggcaggtgctgattgtgtggcaggtggacaggatgaagattagagcatggaatagtttagtaaagcaccatatgtatatatcaaggagagctagtggatggtcctacaaacatcattttgaaagcagacatccaaaagtaagttcagaagtacatatcccattaggggatgctagattagtaataaaaacatattggggtttgcagacaggagaaagagattggcatttgggtcatggagtctccatagaatggagactgagagaatatagcacacaagtagaccctggcctggcagaccagctaattcatatgcattattttgattgttttacagaatctgccataagacaagcaatattaggacacatagttatccctaggtgtgactatcaagcaggacataagaaggtaggatctctacaatacttggcactgacagcattgataaaaccaaaaaggagaaagccacctctgcctagtgttaggaaattagtagaggatagatggaacgacccccagaagaccaggggccgcagagggaaccatacaatgaatggacactagagattctagaagaactcaagcaggaagctgtcagacactttcctagaccatggctccataacttatgaaacctatggggatacttggacgggagttgaagctataataagagtactgcaacaactactgttcattcatttcagaattggatgccaacatagcagaataggcattttgcaacagagaagagcaagaaatggagccagtagatcctaaactagagccctggaaccatccaggaagccaacctaaaactgcttgtaataattgcttttgcaaacactgtagctatcattgtctagtttgctttcagacaaaaggcttaggcatttcctatggcaggaagaagcggagacagcgacgaagcgctcctccaagtggtgaagatcatcaaaatcctctatcaaagcagtaagtactcatagtagatgtaatggtaagtttaagtttagataaaggaatagattatagattaggagtaggagcattaatagtagcactaatcatagcaataatagtgtggaccatagtatatatagaatataaggaaattggtaagacaaaagaaaatagactggttaattaaaagaattagggaaagagcagaagacagtggcaatgagagtgatggggacacagaagaattgtcaacaatggtggatatggggcatcttaggcttctggatgctaatgatttgtaacacggaggacttgtgggtcacagtctactatggggtacctgtgtggagagacgcaaaaactactctattctgtgcatcagatgctaaagcatatgagacagaagtgcataatgtctgggctacacatgcctgtgtacccacagaccccaacccacaagaaatagttttgggaaatgtaacagaaaattttaatatgtggaaaaatgacatggcagatcagatgcatgaggatgtaatcagtttatgggatcaaagcctaaagccatgtgtaaagttgaccccactctgtgtcactttaaactgtacagatacaaatgttacaggtaatagaactgttacaggtaatagtaccaataatacaaatggtacaggtatttataacattgaagaaatgaaaaattgctctttcaatgcaaccacagaattaagagataagaaacataaagagtatgcactcttttatagacttgatatagtaccacttaatgagaatagtgacaactttacatatagattaataaattgcaatacctcaaccataacacaagcctgtccaaaggtctcttttgacccgattcctatacattactgtgctccagctggttatgcgattctaaagtgtaataataagacattcaatgggacaggaccatgttataatgtcagcacagtacaatgtacacatggaattaagccagtggtatcaactcaattactgttaaatggtagtctagcagaagaagggataataattagatctgaaaatttgacagagaataccaaaacaataatagtacaccttaatgaatctgtagagattaattgtacaagacccaacaataatacaagaaaaagtgtaaggataggaccaggacaagcattctatgcaacaaatgatgtaataggaaacataagacaagcacattgtaacattagtacagatagatggaacaaaactttacaacaggtaatgaaaaaattaggagagcatttccctaataaaacaatacaatttaaaccacatgcaggaggggatctagaaattacaatgcatagctttaattgtagaggagaatttttctattgtaatacatcaaacctgtttaatagcacataccactctaataatggtacatacaaatacaatggtaattcaagctcacccatcacactccaatgtaaaataaaacaaattgtacgcatgtggcaaggggtaggacaagcaacgtatgcccctcccattgcaggaaacataacatgtagatcaaacatcacaggaatactattgacacgtgatggaggatttaacaccacaaacaacacagagacattcagacctggaggaggagatatgagggataactggagaagtgaattatataaatataaagtagtagaaattaagccattgggaatagcacccactaaggcaaaaagaagagtggtgcagagagaaaaaagagcagtgggaataggagctgtgttccttgggttcttgggagcagcaggaagcactatgggcgcagcgtcaataacgctgacggtacaggccagacaactgttgtctggtatagtgcaacagcaaagcaatttgctgaaggctatagaggcgcaacagcatatgttgcaactcacagtctggggcattaagcagctccaggcgagagtcctggctatagaaagatacctaaaggatcaacagctcctagggatttggggctgctctggaagactcatctgcaccactgctgtgccttggaactccagttggagtaataaatctgaaaaagatatttgggataacatgacttggatgcagtgggatagagaaattagtaattacacaggcttaatatacaatttgcttgaagactcgcaaaaccagcaggaaaagaatgaaaaagatttattagaattggacaagtggaacaatctgtggaattggtttgacatatcaaactggccgtggtatataaaaatattcataatgatagtaggaggcttgataggtttaagaataatttttgctgtgctttctatagtgaatagagttaggcagggatactcacctttgtcatttcagacccttaccccaagcccgaggggactcgacaggctcggaggaatcgaagaagaaggtggagagcaagacagagacagatccatacgattggtgagcggattcttgtcgcttgcctgggacgatctgcggaacctgtgcctcttcagctaccaccgcttgagagacttcatattaattgcagtgagggcagtggaacttctgggacacagcagtctcaggggactacagagggggtgggaaatccttaagtatctgggaagtcttgtgcaatattggggtctagagctaaaaaagagtgctattagtctgcttgataccatagcaataacagtagctgaaggaacagataggattatagaattagtacaaagaatttgtagagctatcctcaacatacctagaagaataagacagggctttgaagcagctttgctataaaatggggggcaagtggtcaaaatgcagcggatggcctgcagtaagagaaagaatgagacgagctgagccagcagcagagggagtaggaccagcgtctcaagacttagatagacatggggcacttacaagcagcaacacacctgccaataatgatgcttgtgcctggctgcaagcacaggaggaggacggagatgtaggctttccagtcagacctcaggtacctttaagaccaatgacttataagagcgcattcgatctcagcttctttttaaaagaaaaggggggactggatgggttagtttactctaagaaaaggcaagaaatccttgatttgtgggtctataacacacaaggcttcttccctgattggcaaaactacacaccggggccaggggtcagatatccactgacctttggatggtgctacaagctagtgccagttgacccaggggaggtggaagaggccaacggaggagaagacaactgtttgctacaccctatgagccaacatggagcagaggatgaagatagagaagtattaaagtggaagtttgacagtctcctagcacgcagacacatggcccgcgagctacatccggagtattacaaagactgctgacacagaagggactttccgcctgggactttccactggggcgttccgggaggtgtggtctgggcgggacttgggagtggtcaaccctcagatgctgcatataagcagctgcttttcgcttgtactgggtctctctcggtagaccagatctgagcctgggagctctctggctatctagggaacccactgcttaagcctcaataaagcttgccttgagtgctttaagtagtgtgtgcccgtctgttgtgtgactctggtaactagagatccctcagaccctttgtggtagtgtggaaaatctctagcagcggccgc

SEQ ID NO: 182 - DNA, 9691 bp, Artificial Sequence
  Description of Artificial Sequence: 2_1/4_TV12_C_ZA
tggaagggttaatttactctaataaaaggcaagagatccttgatttgtgggtttataacacacaaggcttcttccctgattggcaaaactacacaccggggccaggggtcagatatccactgacctttggatggtgctacaagctagagccagtcgatccaaaggaagtagaagaggccaatgaaggagaaaacaactgtttactacaccctatgagccagcatgggatggaggatgaagacagagaagtattaagatggaagtttgacagtatgctagcacgcagacacatggcccgcgagctacatccggagtattacaaggactgctgacacagaagggactttccgctgggactttccactggggcgttccaggaggtgtggtctgggcgggactggggagtggtcagccctgagatgctgcatataagcagctgcttttcgcctgtactgggtctctctaggtagaccagatctgagcccgggagctctctggctatctagggaacccactgcttaagcctcaataaagcttgccttgagtgccttgagtagtgtgtgcccgtctgttgtgtgactctggtaactagagatccctcagaccacttgtggtgtgtggaaaatctctagcagtggcgcctgaacagggacttgaaagcgaaagtaagaccagaggagatctctcgacgcaggactcggcttgctgaagtgcactcggcaagaggcgagagaggcggctggtgagtacgccaaattttatttgactagcggaggctagaaggagagagatgggtgcgagagcgtcagtattgaaagggaaaaaattagatacatgggaaagaattaggttaaggccagggggaaagaaacactatatgctaaaacacctagtatgggcaagcagggagctggaaagatttgcacttaaccctggccttttagaaacagcagaaggctgtaaacaaataatgcaacagctacaatcagctcttcagacaggaacagaggaacttagatcattatataacacagtagcaactctctattgtgtacataaagagatagatgtacgagacaccaaggaagccttagacaagatagaggaagaacaaaataagagtcagcaaaaaacacagcaagcagaagcggctgacaaaggaaaggtcagtcaaaattatccaatagtgcagaatctccaagggcaaatggtacaccaggccatatcaccgagaactttaaatgcatgggtaaaagtaatagaagagaaggctttcagcccagaggtaatacccatgtttacagcattatcagaaggagctaccccacaagatttaaacaccatgttaaatacagtggggggacaccaagcagccatgcaaatgttaaaagataccatcaatgaggaggctgcagaatgggataggttacatccagtgcatgcagggcctattgcaccaggccaaatgagagaaccaaggggaagtgacatagcaggaactactagtacccttcaagaacaaatagcatggatgacaagtaacccacctattccggtgggagacatctataaaagatggataattctggggttaaataaaatagtaagaatgtatagccctgtcagcattttggacataaaacaagggccaaaagaaccctttagagactatgtagaccgattctttaaaactttaagggctgaacaatcttcacaagaggtaaaaaattggatgacagacaccttgttggtccaaaatgcaaacccagattgtaagaccattttaagagcattaggaccaggggctacattagaggaaatgatgacagcatgtcagggagtaggaggacctggccacaaagcaagagttttggctgaggcaatgagccaagcaaatacaaacataatgatgcagaaaagcaattttaaaggccctaaaagaactgttaaatgtttcaattgtggcaaggaagggcatatagccagaaattgcagggcccctaggaaaaagggctgttggaaatgtggaaaggaaggacaccaaatgaaagactgtactgaaaggcaggctaattttttagggaaaatttggccttcctacaaggggaggccggggaatttccttcagagcagaccagaaccatcagccccaccagcagagagcttcaggttcgaggagcaggagccgaaagacaaggaaccacccttaacttccctcaaatcactctttggcagcgaccccttgtctcaataaaagtagagggccagataaaggaggctctcttagatacaggagcagatgatacagtattagaagaaataaatttgccaggaaaatggaaaccaaaaatgataggaggaattggaggttttatcaaagtaagacagtatgagcaaatacttatagaaatttgtggaaaaaaggctataggaacagtattagtaggacctacacctgtcaacataattggaagaaatatgttgactcagcttggatgcacactaaattttccaattagtcccattgaaactgtaccagtaaaattaaagccaggaatggatggcccaagagttaaacaatggccattgacagaagaaaaaataaaagcattaacagcaatttgtgaagaaatggagaaggaaggaaaaattacaaaaattgggcctgaaaatccatataacactccagtatttgccataaaaaagaaggacagtactaagtggagaaaattagtagatttcagggaactcaataaaagaactcaagacttttgggaagttcaattaggaataccacacccagcagggttaaaaaagaaaaaatcagtgacagtgctggatgtgggggatgcatatttttcagttcctttagatgaaagcttcaggaaatatactgcattcaccatacctagtataaacaatgaagcaccagggattagatatcaatataatgtgcttccacaggggtggaaaggatcaccagcaatattccagtgtagcatgacaaaaatcttagagccttataggaaacaaaatccaaacatagttatctatcaatatatggatgatttgtatgtaggatctgacttagaaatagggcaacatagagcaaaaatagaggagttaagagaacatttattgaggtggggacttaccacaccagacaagaaacatcagaaagaacccccatttctctggatggggtatgaactacatcctgacaaatggacagtacagcctatactgctgccagaaaaggatagctggactgtcaatgatatacagaagttagtgggaaagttaaactgggccagtcagatttacccagggattaaagtaaagtacttgtgcaaactccttaggggagccaaagcactaacagacatagtaccactgactgaagaagctgaattagaattggcagagaacagggaaattctaaaagaaccagtacatggagtatattatgacccctcaaaagacttaatagctgaaatacagaaacaggggcatgaccaatggacataccaaatttaccaagaaccattcaaaaatctgaaaacagggaagtatgcaaaaatgaggactgcccacactaatgatgtaaaacagttaacagaagcagtgcaaaaaatagctctagaaagcatagtaatatggggaaagactcctaaattcagactacccatccaaaaagaaacatgggagacatggtggacagactattggcaagccacctggatccctgaatgggagtttgttaatacccctcccctagtaaaattatggtaccaactggaaaaagaacccatagcaggggtagagactttctatgtagatggagcagctaacagggaaactaaaataggaaaagcagggtatgttactgacaaaggaagacagaaaattgttactctaaatgaaacaacaaatcagaaggctgagttacaagcaattcagctagctttgcaggattcaggatcagaagcaaacatagtaacagactcacagtatgcattaggaattattcaagcacaaccagataagagtgaatcagagttagttaaccagataatagaacagttaataaacaaggagagaatctacctgtcatgggtaccagcacataaaggaattggaggaaatgaacaagtagacaaattagtaagtagtggaatcaggaaagtgctgtttctagatgggatagataaggctcaagaagagcatgaaaaatatcacagcaattggagagcaatggctagtgagtttaatctgccacccatagtagcaaaagaaatagtagccagctgtgataaatgtcagctaaaaggggaagccatacatggacaagtcgactgtagtccaggaatatggcaattagattgtacacatttagaaggaaaaatcatcctggtagcagtccatgtagccagtggctacatagaagcagaggttatcccagcagaaacaggacaagaaacagcatattatatactaaaattagcaggaagatggccagttaaaataatacatacagataatggcagtaatttcaccagtgctgcagttaaagcagcctgttggtgggcaggaatccaacaggaatttggaattccctacaatccccaaagtcagggagtagtagaatccatgaataaagaattaaagaaaatcatagggcaggtaagagatcaagctgagcacctcaagacagcagtacaaatggcagtattcattcacaattttaaaagaaaaggggggattggggggtacagtgcaggggaaaggataatagacataatagcaacagacatacaaactagagaattacaaaaacaaattataaaaattcaaaattttcgggtttattacagggacagcagagaccctatttggaaaggaccagccaaactactctggaaaggtgaaggggcagtagtaatacaagataatagtgacataaaggtagtaccaaggaggaaagtaaaaatcattaaggactatggaaaacagatggcaggtgctgattgtgtggcaggtagacaggatgaagattagaacatggaatagtttggtaaagcatcacatatatatttcaaggagagctaatggatggttttacagacatcattatgaaagcagacacccaaaaataagttcagaagtacacatcccattaggggatgctagattagtaataaaaacatattggggtttgcatacaggagaaagagattggcatttgggtcatggagtctccatagaatggaaattgagaaaatatagcacacaagtagaccctggcctggcagaccagctaattcatgtgcattattttgattgttttgcagactctgccataagacaagccatattaggacacatagttattcctaggtgtgactatcaagcaggacataataaggtaggatctctacaatacttggcactgacagcattgataaaaccaaaaaagagaaagccacctttgcatagtgttaggaaattagtagaggatagatggaacaagccccagaagaccagggaccgcagagggaaccatacaatgaatggacactagagcttttagaggaactcaaacaggaagctgtcagacactttcctagaccatggctccatagcttagggcaacatatctataacacctatggggatacttggacaggagtagaagctataataagaattctgcaacaactactgtttattcatttcagaattgggtgccagcatagcagaataggcattatgcgacagagaagagcaagaaatggaaccagtagatcctaaacttgagccctggaaacatccaggaagtcagcctaaaactccttgtaataattgctattgcaaaaaatgtagctatcattgtctagtttgctttcagaaaaaaggcttaggcatttcatatggcaggaagaagcggagacaacgacgaagcactcctccaagcagtgaggatcatcaaaatcttatatcaaagcagtaagtactaaatggtagatgtaatgttaagttttctagaaaaagtagattatgaaataggagtagcagcatttataatagcactaatcatagcaatagttgtgtggatcatagtatatatagaatataggaaattgttaagacaaaaaagaatagactggttaattgaaagaattagagaaagggcagaagacagtggcaatgagagtgatggggagcaggaggaattatcaacaatggtggatatggggaatcttaggcttttggatgctaatggttggtaatgtaatggggaacttgtgggtcacagtctattatggggtacctgtgtggaaagacgcaaaagctactctattttgtgcatctgatgctaaagcatatgagaaagaagtgcataatgtctgggctacacatgcctgtgtacccacagaccccgacccacaagaaatagttttggagaatgtaacagaaaattttaacatgtggaaaaataacatggtggaccagatgcatgaggatataatcagcttatgggatcaaagcctaaagccatgtgtaaagttgaccccactctgtgtcactttaaactgtagcaataatgttaaaaatgctaccaacagtatgaaggaaatgaaaaattgcactttcaatataaccacagaactaagagataagagaaagcaagaatatgcacttttttataaacttgatatagtaccacttgaggagaattccagtaagtatagattaataaattgtaatacctcagccataacccaagcctgtccaaaggtctcttttgacccaattcctatacattattgtgctccagctggttatgcgattctaaagtgtaataataagacattcaatggaacaggaccatgcaataatgtcagcacggtacaatgtacacatggaattaagccagtagtatcaactcaactactgttaaatggtagtctagcagaagaagaaatagtaattagatctgaaaatatgacaaacaatgccaaaataataatagtacatcttaatgaatctgtagaaattacgtgtacaaggcccaacaataatacaagaaaaagtatgaggataggaccaggacaaacattctatgcaacaggagacataataggagatataagacaagcacactgtaacattagtgaaaagcaatgggatcagactttatacagggtaagtgaaaaattaaaagaacacttccctaataaaacaataaagtttaactcatcctcaggaggggacttagaaattacaacacatagctttaattgtggaggagagtttttctattgcaatacatctgtactgtttaatggcacatacagtaatggcacaaacagtacaaatacaacagtcatcacactcccatgcagaataaaacaaattataaacatgtggcagggggtaggacgagcaatgtatgcccctcccattgcaggaaacataacatgtagatcaaacatcacaggactaatattgacacgtgatggagggcagggagagaatgacacaaatgagatatttagacctgcaggaggagatatgagggacaattggagaagtgaattatacaaatataaagtggtagaaattcagccattaggagtagcacccactaaggcaaaaaggagagtggtggagagagaaaaaagagcagctttgggagctgtgttccttgggttcttgggagcagcaggaagcactatgggcgcggcatcaataatgctgacggtacaggccagacaactgttgtctggtatagtgcaacagcaaagcaatttgctgagagctgtagaggcgcaacagcatatgttgcaactcacggtctggggcattaagtagctccagacaagagtcctggctatagaaagatacctaaaggatcaacagctcctagggatttggggctgctctggaaaactcatctgcaccactgccgtgccttggaacaatagttggagtaataaatctcaagattatatttggggaaacatgacctggatgcaatgggataaagaaattagcaattacacagaaacaatatacaggttgcttggggacgcgcaaaaccagcaggagaaaaatgaaaaggagttactagaattggacaggtggggaaatctgtggaactggtttgacataacaaaatggctgtggtatataaaaatattcataatggtaataggaggcttgataggtttaagaataatttttgctgtgctttctatagtaaatagagttaggcagggatactcacctttgtcatttcagacccttgcccaaaacccgaggggacccgacaggctcggaagaaccgaagaagaaggtggagagcaagacagagacagatccataagattagtgagcggattcttagcacttgcctgggaggacctgaggaacctgtgcattttcctctaccaccgattgagagacttcatattggtgacagcgagagcagtggaacttctgggacgcagcagtctcaggggactccagagggggtgggaaatccttaagtacctgggaagtcttgtgcagtattggggtctagagctaaaaaagagtgctgttagtctgcttgatagcgtagcaatagcagtagctgagggaacagatagaattatagaattcttacaaggaactggtagagctatctacaacatacctagaagaataagacagggctttgaagcagctttgcagtaaaatgggaaataagtggtcaaaaagctggcctgctgtaagagaaagaatatggaaaactaggccagcagcagcagaagcagctaggccagcagcagcagaaggagtaggagcagcgtctcaagacttggataaacgtggggcgcttacaatcaacaacacagccaacaataatcctgattgtgcctggctggaagcgcaagaggatgaggaagtaggctttccagtcagacctcaggtacctttaagaccaatgacatataaggcagcatttgatctcagcttctttttaaaagaaaaggggggactggaagggttaatttactccaggaaaaggcaagagatccttgatttatgggtctatcacacacaaggctacttccctgattggcaaaactacacaccgggaccaggggtcagatatccactgacctttggatggtgcttcaagctagtgccagttgacccaagggaagtagaagaggccaacggaggagaagacaactgtttgctacaccctatgagccagtatggaatggatgatgaacacaaagaagtgctacagtggaagtttgacagcagcctagcacgcagacacctggcccgcgagctacatccggattattacaaagactgctgacacagaagggactttccgcctgggactttccactggggcgttccagggggagtggtctgggcgggactgggagtggccagccctcagatgctgcatataagcagctgcttttcgcctgtactgggtctctctaggtagaccagatctgagcctgggagctctctgtctatctggggaacccactgcttaagcctcaataaagcttgccttgagtgctctaagtagtgtgtgcccatctgttgtgtgactctggtaactctggtaactagagatccctcagaccctttgtggtagtgtggaaaatctctagca

SEQ ID NO: 183 - DNA, 1974 bp, Artificial Sequence
  Description of Artificial Sequence: gp140.modTV1.mut1.dV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagagcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 184 - DNA, 1974 bp, Artificial Sequence
  Description of Artificial Sequence: gp140mod.TV1.mut2.dV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagagcgagaagagcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 185 - DNA, 1974 bp, Artificial Sequence
  Description of Artificial Sequence: gp140mod.TV1.mut3.dV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgcagcgtggtgcagagcgagaagagcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 186 - DNA, 1974 bp, Artificial Sequence
  Description of Artificial Sequence: gp140mod.TV1.mut4.dV2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagagcagcgtggtgcagagcgagaagagcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 187 - DNA, 2061 bp, Artificial Sequence
  Description of Artificial Sequence: gp140.mod.TV1.GM161
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagcagtgcagcttcaacgccaccaccgagctgcgcgacaagaagcacaaggagtacgccctgttctaccgcctggacatcgtgcccctgaacgagaacagcgacaacttcacctaccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 188 - DNA, 2061 bp, Artificial Sequence
  Description of Artificial Sequence: gp140mod.TV1.GM161-195-204
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagcagtgcagcttcaacgccaccaccgagctgcgcgacaagaagcacaaggagtacgccctgttctaccgcctggacatcgtgcccctgaacgagaacagcgaccagttcacctaccgcctgatcaactgccagaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 189 - DNA, 2061 bp, Artificial Sequence
  Description of Artificial Sequence: gp140mod.TV1.GM161-204
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagcagtgcagcttcaacgccaccaccgagctgcgcgacaagaagcacaaggagtacgccctgttctaccgcctggacatcgtgcccctgaacgagaacagcgacaacttcacctaccgcctgatcaactgccagaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 190 - DNA, 2061 bp, Artificial Sequence
  Description of Artificial Sequence: gp140mod.TV1.GM-V1V2
atgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgcagtgcaccgacacccaggtgaccggccagcgcaccgtgaccggccagagcacccagaacacccagggcaccggcatctacaacatcgaggagatgaagcagtgcagcttccaggccaccaccgagctgcgcgacaagaagcacaaggagtacgccctgttctaccgcctggacatcgtgcccctgaacgagaacagcgaccagttcacctaccgcctgatcaactgccagaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccaagcgccgcgtggtgcagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaa

SEQ ID NO: 191 - DNA, 1981 bp, Artificial Sequence
  Description of Artificial Sequence: gp140modC8.2mut7.delV2.Kozmod.Ta
gccaccatgcgcgtgatgggcacccagaagaactgccagcagtggtggatctggggcatcctgggcttctggatgctgatgatctgcaacaccgaggacctgtgggtgaccgtgtactacggcgtgcccgtgtggcgcgacgccaagaccaccctgttctgcgccagcgacgccaaggcctacgagaccgaggtgcacaacgtgtgggccacccacgcctgcgtgcccaccgaccccaacccccaggagatcgtgctgggcaacgtgaccgagaacttcaacatgtggaagaacgacatggccgaccagatgcacgaggacgtgatcagcctgtgggaccagagcctgaagccctgcgtgaagctgacccccctgtgcgtgaccctgaactgcaccgacaccaacgtgaccggcaaccgcaccgtgaccggcaacagcaccaacaacaccaacggcaccggcatctacaacatcgaggagatgaagaactgcagcttcaacgccggcgccggccgcctgatcaactgcaacaccagcaccatcacccaggcctgccccaaggtgagcttcgaccccatccccatccactactgcgcccccgccggctacgccatcctgaagtgcaacaacaagaccttcaacggcaccggcccctgctacaacgtgagcaccgtgcagtgcacccacggcatcaagcccgtggtgagcacccagctgctgctgaacggcagcctggccgaggagggcatcatcatccgcagcgagaacctgaccgagaacaccaagaccatcatcgtgcacctgaacgagagcgtggagatcaactgcacccgccccaacaacaacacccgcaagagcgtgcgcatcggccccggccaggccttctacgccaccaacgacgtgatcggcaacatccgccaggcccactgcaacatcagcaccgaccgctggaacaagaccctgcagcaggtgatgaagaagctgggcgagcacttccccaacaagaccatccagttcaagccccacgccggcggcgacctggagatcaccatgcacagcttcaactgccgcggcgagttcttctactgcaacaccagcaacctgttcaacagcacctaccacagcaacaacggcacctacaagtacaacggcaacagcagcagccccatcaccctgcagtgcaagatcaagcagatcgtgcgcatgtggcagggcgtgggccaggccacctacgccccccccatcgccggcaacatcacctgccgcagcaacatcaccggcatcctgctgacccgcgacggcggcttcaacaccaccaacaacaccgagaccttccgccccggcggcggcgacatgcgcgacaactggcgcagcgagctgtacaagtacaaggtggtggagatcaagcccctgggcatcgcccccaccaaggccatcagcagcgtggtgcagagcgagaagagcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgaaggccatcgaggcccagcagcacatgctgcagctgaccgtgtggggcatcaagcagctgcaggcccgcgtgctggccatcgagcgctacctgaaggaccagcagctgctgggcatctggggctgcagcggccgcctgatctgcaccaccgccgtgccctggaacagcagctggagcaacaagagcgagaaggacatctgggacaacatgacctggatgcagtgggaccgcgagatcagcaactacaccggcctgatctacaacctgctggaggacagccagaaccagcaggagaagaacgagaaggacctgctggagctggacaagtggaacaacctgtggaactggttcgacatcagcaactggccctggtacatctaaa

SEQ ID NO: 192 - protein, 50 aa, Artificial Sequence
  Description of Artificial Sequence: gp140mod.TV1.delV2
RDNWRSELYKYKVVEIKPLGIAPTKAKRRVVQREKRAVGIGAVFLGFLGA

SEQ ID NO: 193 - protein, 50 aa, Artificial Sequence
  Description of Artificial Sequence: gp140mod.TV1.mut1.dV2
RDNWRSELYKYKVVEIKPLGIAPTKAKRRVVQREKSAVGIGAVFLGFLGA

SEQ ID NO: 194 - protein, 50 aa, Artificial Sequence
  Description of Artificial Sequence: gp140mod.TV1.mut2.dV2
RDNWRSELYKYKVVEIKPLGIAPTKAKRRVVQSEKSAVGIGAVFLGFLGA

SEQ ID NO: 195 - protein, 50 aa, Artificial Sequence
  Description of Artificial Sequence: gp140mod.TV1.mut3.dV2
RDNWRSELYKYKVVEIKPLGIAPTKAKRSVVQSEKSAVGIGAVFLGFLGA

SEQ ID NO: 196 - protein, 50 aa, Artificial Sequence
  Description of Artificial Sequence: gp140mod.TV1.mut4.dV2
RDNWRSELYKYKVVEIKPLGIAPTKAKSSVVQSEKSAVGIGAVFLGFLGA

SEQ ID NO: 197 - protein, 50 aa, Artificial Sequence
  Description of Artificial Sequence: gp140mod.TV1.mut7.dV2
RDNWRSELYKYKVVEIKPLGIAPTKAISSVVQSEKSAVGIGAVFLGFLGA

SEQ ID NO: 198 - protein, 150 aa, Artificial Sequence
  Description of Artificial Sequence: gp140mod.TV1
QMHEDVISLWDQSLKPCVKLTPLCVTLNCTDTNVTGNRTVTGNSTNNTNGTGIYNIEEMKNCSFNATTELRDKKHKEYALFYRLDIVPLNENSDNFTYRLINCNTSTITQACPKVSFDPIPIHYCAPAGYAILKCNNKTFNGTGPCYNVS

SEQ ID NO: 199 - protein, 150 aa, Artificial Sequence
  Description of Artificial Sequence: gp140mod.TV1.GM161
QMHEDVISLWDQSLKPCVKLTPLCVTLNCTDTNVTGNRTVTGNSTNNTNGTGIYNIEEMKQCSFNATTELRDKKHKEYALFYRLDIVPLNENSDNFTYRLINCNTSTITQACPKVSFDPIPIHYCAPAGYAILKCNNKTFNGTGPCYNVS

SEQ ID NO: 200 - protein, 150 aa, Artificial Sequence
  Description of Artificial Sequence: gp140mod.TV1.GM161-204
QMHEDVISLWDQSLKPCVKLTPLCVTLNCTDTNVTGNRTVTGNSTNNTNGTGIYNIEEMKQCSFNATTELRDKKHKEYALFYRLDIVPLNENSDNFTYRLINCQTSTITQACPKVSFDPIPIHYCAPAGYAILKCNNKTFNGTGPCYNVS

SEQ ID NO: 201 - protein, 150 aa, Artificial Sequence
  Description of Artificial Sequence: gp140mod.TV1.GM161-195-204
QMHEDVISLWDQSLKPCVKLTPLCVTLNCTDTNVTGNRTVTGNSTNNTNGTGIYNIEEMKQCSFNATTELRDKKHKEYALFYRLDIVPLNENSDQFTYRLINCQTSTITQACPKVSFDPIPIHYCAPAGYAILKCNNKTFNGTGPCYNVS

SEQ ID NO: 202 - protein, 150 aa, Artificial Sequence
  Description of Artificial Sequence: gp140mod.TV1.GM-V1V2
QMHEDVISLWDQSLKPCVKLTPLCVTLQCTDTQVTGQRTVTGQSTQNTQGTGIYNIEEMKQCSFQATTELRDKKHKEYALFYRLDIVPLNENSDQFTYRLINCQTSTITQACPKVSFDPIPIHYCAPAGYAILKCNNKTFNGTGPCYNVS

SEQ ID NO: 203 - DNA, 627 bp, Artificial Sequence
  Description of Artificial Sequence: Nef-myrD124LLAA
atggccggcaagtggagcaagagcagcatcgtgggctggcccgccgtgcgcgagcgcatccgccgcaccgagcccgccgccgagggcgtgggcgccgccagccaggacctggacaagcacggcgccctgaccagcagcaacaccgccgccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccggctggcagaactacacccccggccccggcgtgcgctaccccctgaccttcggctggtgcttcaagctggtgcccgtggacccccgcgaggtggaggaggccaacaagggcgagaacaactgcgcggcgcaccccatgagccagcacggcatggaggacgaggaccgcgaggtgctgaagtggaagttcgacagcagcctggcccgccgccacatggcccgcgagctgcaccccgagtactacaaggactgcgcctaa

SEQ ID NO: 204 - protein, 208 aa, Artificial Sequence
  Description of Artificial Sequence: Nef-myrD124LLAA
MAGKWSKSSIVGWPAVRERIRRTEPAAEGVGAASQDLDKHGALTSSNTAANNADCAWLEAQEEEEEVGFPVRPQVPLRPMTYKAAFDLSFFLKEKGGLEGLIYSKKRQEILDLWVYHTQGFFPGWQNYTPGPGVRYPLTFGWCFKLVPVDPREVEEANKGENNCAAHPMSQHGMEDEDREVLKWKFDSSLARRHMARELHPEYYKDCA

SEQ ID NO: 205 - DNA, 2565 bp, Artificial Sequence
  Description of Artificial Sequence: gp160mod.TV2
atgcgcgcccgcggcatcctgaagaactaccgccactggtggatctggggcatcctgggcttctggatgctgatgatgtgcaacgtgaagggcctgtgggtgaccgtgtactacggcgtgcccgtgggccgcgaggccaagaccaccctgttctgcgccagcgacgccaaggcctacgagaaggaggtgcacaacgtgtgggccacccacgcctgcgtgcccaccgaccccaacccccaggaggtgatcctgggcaacgtgaccgagaacttcaacatgtggaagaacgacatggtggaccagatgcaggaggacatcatcagcctgtgggaccagagcctgaagccctgcgtgaagctgacccccctgtgcgtgaccctgaactgcaccaacgccaccgtgaactacaacaacaccagcaaggacatgaagaactgcagcttctacgtgaccaccgagctgcgcgacaagaagaagaaggagaacgccctgttctaccgcctggacatcgtgcccctgaacaaccgcaagaacggcaacatcaacaactaccgcctgatcaactgcaacaccagcgccatcacccaggcctgccccaaggtgagcttcgaccccatccccatccactactgcgcccccgccggctacgcccccctgaagtgcaacaacaagaagttcaacggcatcggcccctgcgacaacgtgagcaccgtgcagtgcacccacggcatcaagcccgtggtgagcacccagctgctgctgaacggcagcctggccgaggaggagatcatcatccgcagcgagaacctgaccaacaacgtgaagaccatcatcgtgcacctgaacgagagcatcgagatcaagtgcacccgccccggcaacaacacccgcaagagcgtgcgcatcggccccggccaggccttctacgccaccggcgacatcatcggcgacatccgccaggcccactgcaacatcagcaagaacgagtggaacaccaccctgcagcgcgtgagccagaagctgcaggagctgttccccaacagcaccggcatcaagttcgccccccacagcggcggcgacctggagatcaccacccacagcttcaactgcggcggcgagttcttctactgcaacaccaccgacctgttcaacagcacctacagcaacggcacctgcaccaacggcacctgcatgagcaacaacaccgagcgcatcaccctgcagtgccgcatcaagcagatcatcaacatgtggcaggaggtgggccgcgccatgtacgccccccccatcgccggcaacatcacctgccgcagcaacatcaccggcctgctgctgacccgcgacggcggcgacaacaacaccgagaccgagaccttccgccccggcggcggcgacatgcgcgacaactggcgcagcgagctgtacaagtacaaggtggtggagatcaagcccctgggcgtggcccccaccgccgccaagcgccgcgtggtggagcgcgagaagcgcgccgtgggcatcggcgccgtgttcctgggcttcctgggcgccgccggcagcaccatgggcgccgccagcatcaccctgaccgtgcaggcccgccagctgctgagcggcatcgtgcagcagcagagcaacctgctgcgcgccatcgaggcccagcagcacatgctgcagctgaccgtgtggggcatcaagcagctgcaggcccgcgtgctggccatcgagcgctacctgcaggaccagcagctgctgggcctgtggggctgcagcggcaagctgatctgcaccaccaacgtgctgtggaacagcagctggagcaacaagacccagagcgacatctgggacaacatgacctggatgcagtgggaccgcgagatcagcaactacaccaacaccatctaccgcctgctggaggacagccagagccagcaggagcgcaacgagaaggacctgctggccctggaccgctggaacaacctgtggaactggttcagcatcaccaactggctgtggtacatcaagatcttcatcatgatcgtgggcggcctgatcggcctgcgcatcatcttcgccgtgctgagcctggtgaaccgcgtgcgccagggctacagccccctgagcctgcagaccctgatccccaacccccgcggccccgaccgcctgggcggcatcgaggaggagggcggcgagcaggacagcagccgcagcatccgcctggtgagcggcttcctgaccctggcctgggacgacctgcgcagcctgtgcctgttctgctaccaccgcctgcgcgacttcatcctgatcgtggtgcgcgccgtggagctgctgggccacagcagcctgcgcggcctgcagcgcggctggggcaccctgaagtacctgggcagcctggtgcagtactggggcctggagctgaagaagagcgccatcaacctgctggacaccatcgccatcgccgtggccgagggcaccgaccgcatcctggagttcatccagaacctgtgccgcggcatccgcaacgtgccccgccgcatccgccagggcttcgaggccgccctgcagtaa

SEQ ID NO: 206 - protein, 102 aa, Artificial Sequence
  Description of Artificial Sequence: Tat TV001
MEPVDPNLEPWNHPGSQPKTACNNCFCKHCSYHCLVCFQTKGLGISYGRKKRRQRRSAPPSGEDHQNPLSKQPLPQARGDPTGSEESKKKVESKTETDPYDW

SEQ ID NO: 207 - protein, 101 aa, Artificial Sequence
  Description of Artificial Sequence: Tat TV002
MEPIDPNLEPWNHPGSQPKTACNGCYCKRCSYHCLVCFQKKGLGIYYGRKKRRQRRSAPPSNKNHQDPLPKQPLSQTRGDPTGSEESKKKVESKTETDPFD

SEQ ID NO: 208 - protein, 101 aa, Artificial Sequence
  Description of Artificial Sequence: Tat TV003
MEPIDPNLEPWNHPGSQPKTACNKCYCKVCSYHCLVCFQTKGLGIYYGRKKRRQRRSAPPSSEDHQNPISKQPFSQARGDPTGSEESKKKVESKTETDPCD

SEQ ID NO: 209 - protein, 99 aa, Artificial Sequence
  Description of Artificial Sequence: Tat TV004
MEPVDPRIEPWNQPGSQPKTACNNCYCKYCCYHCIVCFQTKGLGISYGRKKRRQRRSTPPSSKDHQNPISKQPLPRAQGDPTGSEESKKKVESKTETDP

SEQ ID NO: 210 - protein, 101 aa, Artificial Sequence
  Description of Artificial Sequence: Tat TV005
MEPVDPNLEPWNHPGSQPKTACNKCYCKYCSYHCLVCFQTKGLGISYGRKKRRQRRSTPPSSEDHQNLVSKQPLPQTRGDPTGPEESKKKVESKTKTDPFD

SEQ ID NO: 211 - protein, 101 aa, Artificial Sequence
  Description of Artificial Sequence: Tat TV006
MEPVDPNLEPWNHPGSQPITPCNKCYCKSCSYHCLVCFQTKGLGISYGRKKRRQRRSTPPSSEGHQNPLSKQPLPRTQGNSTGSEESKKKVESKTETDRFD

SEQ ID NO: 212 - protein, 101 aa, Artificial Sequence
  Description of Artificial Sequence: Tat TV007
MEPIDPNLEPWNHPGSQPKTACNSCYCKHCSYHCLVCFQTKGLGISYGRKKRRQRRSAPPSSEDHQNLISKQPLPQTRGDPTGSEESKKKVESKTKTDPFD

SEQ ID NO: 213 - protein, 101 aa, Artificial Sequence
  Description of Artificial Sequence: Tat TV008
MDPVDPRLEPWNHPGSQPKTACNNCYCKYCSYHCLVCFQTKGLGISYGRKKRRQRRSAPSSSEDHQNLISKQPLSQTRGDQTGSEESKKKVESKTKTDPCD

SEQ ID NO: 214 - protein, 99 aa, Artificial Sequence
  Description of Artificial Sequence: Tat TV010
MEPIDPNLEPWNHPGSQPATPCNKCYCKYCCYHCLACFQTKGLGISYGRKKRRQRRSASPSSKDHQNPIPKQPLSQTRGDPTGPEESKKKVESKTETDP

SEQ ID NO: 215 - protein, 99 aa, Artificial Sequence
  Description of Artificial Sequence: Tat TV012
MEPVDPKLEPWKHPGSQPKTPCNNCYCKKCSYHCLVCFQKKGLGISYGRKKRRQRRSAPPSSEDHQNLISKQPLPKTRGDPTGSEEPKKKVESKTETDP

SEQ ID NO: 216 - protein, 101 aa, Artificial Sequence
  Description of Artificial Sequence: Tat TV013
MEPIDPNLEPWKHPGSQPKTPCNKCYCKHCSYHCLVCFQTKGLGISYGRKKRRQRRSTPPSSEDHQNLISKQPLSQTRGNPTGSEESKKKVESKTKTDQFD

SEQ ID NO: 217 - protein, 101 aa, Artificial Sequence
  Description of Artificial Sequence: Tat TV014
MEPVDPSLESWKHPGSQPNTACNRCYCKRCCYHCLVCFQKKGLGISYGRKKRRQRRSAPPSSEDHQNLISKQPLPQTRGDPTGSEESKKKVESKTETDPFD

SEQ ID NO: 218 - protein, 99 aa, Artificial Sequence
  Description of Artificial Sequence: Tat TV018
MEQVDPNLEPWNHPGSQPKTPCNKCYCKVCSYHCLVCFQTKGLGISYGRKKRRQRRSAPPSSEDHQNLVSKQPLPQTRGDQTGSEESKKKVESKTETDP

SEQ ID NO: 219 - protein, 101 aa, Artificial Sequence
  Description of Artificial Sequence: Tat TV019
MEPVDPNLEPWNHPGSQPKTACNTCYCKKCSYHCLVCFQTKGLGISYGRKKRRQRRSAPPSSEDHQNPISKQPLPRTQGDPTGSEESKKKVESKTETDPFD

SEQ ID NO: 220 - protein, 101 aa, Artificial Sequence
  Description of Artificial Sequence: Tat 92BR025
MEPVDPNLEPWNHPGSQPKTACNNCYCKRCSYHCLVCFQTKGLGISYGRKKRRQRRSAPPSSEDHQNPIPKQPLPQTRGDQTGSEESKKKVESKTETDPFD

SEQ ID NO: 221 - protein, 101 aa, Artificial Sequence
  Description of Artificial Sequence: Tat 301904-Ind
MEPVDPNLEPWNHPGSQPKTACNNCYCKHCSYHCLVCFQKKGLGISYGRKKRRQRRRAPQSSEDHQNLISKQPLPRTQGDPTGSEESKKKVESKAKTDPFA

SEQ ID NO: 222 - protein, 101 aa, Artificial Sequence
  Description of Artificial Sequence: Tat 301905-Ind
MEPVDPNLEPWNHPGSQPKTACNTCYCKYCSYHCLVCFQTKGLGISYGRKKRRQRRSAPQSSEDHQNLISKQPLPRTQGDTTGSEESKKKVESKTKTDPFD

SEQ ID NO: 223 - protein, 101 aa, Artificial Sequence
  Description of Artificial Sequence: Tat 301999-Ind
MEPVDPNLEPWNHPGSQPRTACNNCFCKSCSYHCLVCFQKKGLGISYGRKKRRQRRSAPPSSEDHQNLISKQPLPRTQGDPTGSEESKKKVESKTKTDPFA

SEQ ID NO: 224 - protein, 101 aa, Artificial Sequence
  Description of Artificial Sequence: Tat 96BW16-D14
MEPVDPKLEPWNHPGSQPKTACNKCYCKRCSYHCLVCFQTKGLGISYGRKKRRQRRSAPPSSEDHQNPISKQPLPQTQGDPTGSEESKKKVESKTEADPCD

SEQ ID NO: 225 - protein, 101 aa, Artificial Sequence
  Description of Artificial Sequence: Tat 96BW04-09
MEPIDPNLEPWNHPGSQPKTACNKCYCKHCSYHCLVCFQTKGLGISYGRKKRRQRRSTPPSSEDHQNPVSKQPLSQTRGDPTGSEESKKKVESKTEADPFD

SEQ ID NO: 226 - protein, 101 aa, Artificial Sequence
  Description of Artificial Sequence: Tat 96BW12-10
MEPVDPNLEPWNHPGSQPKIACNKCYCKACCYHCLVCFQTKGLGISYGRKKRRQRRSAPPSSEDHQDLVPKQPLSQARGNPTSSKESKKKVESKTETDPFD

SEQ ID NO: 227 - protein, 101 aa, Artificial Sequence
  Description of Artificial Sequence: Tat C2220-Eth
  SITE (40): where Xaa = unknown amino acid
MEPVDPNLEPWNHPGSQPKTACNQCYCKKCSYHCLVCFLXKGLGISYGRKKRRQRRRAPQSSKDHQNLISKQPLSHTRGDPTGSEESKKKVESKAETDPYA

SEQ ID NO: 228 - protein, 101 aa, Artificial Sequence
  Description of Artificial Sequence: Tat HXB2
  SITE (87): where Xaa is a stop codon
MEPVDPRLEPWKHPGSQPKTACTNCYCKKCCFHCQVCFITKALGISYGRKKRRQRRRAHQNSQTHQASLSKQPTSQPRGDPTGPKEXKKKVERETETDPFD

SEQ ID NO: 229 - protein, 102 aa, Artificial Sequence
  Description of Artificial Sequence: Tat Consensus
MEPVDPNLEPWNHPGSQPKTACNKCYCKHCSYHCLVCFQTKGLGISYGRKKRRQRRSAPPSSEDHQNLISKQPLPQTRGDPTGSEESKKKVESKTETDPFDW

SEQ ID NO: 230 - protein, 126 aa, Artificial Sequence
  Description of Artificial Sequence: Rev TV1
  SITE (108): where Xaa = subtype C premature stop
MAGRSGDSDEALLQVVKIIKILYQSNPYPKPEGTRQARRNRRRRWRARQRQIHTIGERILIACLGRSAEPVPLQLPPLERLHINCSEGSGTSGTQQSQGTTEGVGNPXVSGKSCAILGSRAKKECY

SEQ ID NO: 231 - protein, 126 aa, Artificial Sequence
  Description of Artificial Sequence: Rev TV2
  SITE (108): where Xaa = subtype C premature stop
MAGRSGDSDEALLQAIKIIKILYQSNPYPKPEGTRQARRNRRRRWRARQRQIHSISERILDTCLGRSTEPVPFLLPPIERLHINCSESSGTSGTQQSQGTAEGVGNPXVSGESCAILGSRVKKECY

SEQ ID NO: 232 - protein, 126 aa, Artificial Sequence
  Description of Artificial Sequence: Rev TV3
  SITE (108): where Xaa = subtype C premature stop
MAGRSGDSDEALLQAVRTIRILYQSNPSPKPEGTRQARKNRRRRWRARQRQIRAISERILSHCLGRSTEPVSFQLPPIERLHIDCNESGGTSGTQQSQGIAEGVGSPXVSRKSCAVLGSGTKKECC

SEQ ID NO: 233 - protein, 126 aa, Artificial Sequence
  Description of Artificial Sequence: Rev TV4
  SITE (108): where Xaa = subtype C premature stop
MAGRSGDSDEALLQAVRTIKILYQSNPYPEPRGTRQARKNRRRRWRARQRQIREISERILSTCLGRPAEPVPFQLPPIERLHIGDSESGGTSGTQQSQGTTEGVGSSXVSGKPCAILGSGAKKECY

SEQ ID NO: 234 - protein, 126 aa, Artificial Sequence
  Description of Artificial Sequence: Rev TV5
MAGRSGDSDEALLQAVRTIKILYQSNPYPKPEGTRQARKNRRRRWRARQRQIHSISERILSTCLGRSAEPVPLQLPPIERLHIGCSESSGTSGTQQSQGTTERVGSPQISGESDTVLGSGAKKECY

SEQ ID NO: 235 - protein, 126 aa, Artificial Sequence
  Description of Artificial Sequence: Rev TV6
  SITE (108): where Xaa = subtype C premature stop
MAGRSEASDEALLQAVKVIKILYQSNPCPEPKGTRQARKNRRRRWRARQRQIDSISARILSTCVGRPEEPVPFQLPPIERLHIDCSESSGTSGTQQSQGTTEGVGNPXVSGKSCSILGSRTQKECY

SEQ ID NO: 236 - protein, 126 aa, Artificial Sequence
  Description of Artificial Sequence: Rev TV7
  SITE (108): where Xaa = subtype C premature stop
MAGRSGDSDEALLQAVRIIKILYQSNPYPKPEGTRQARKNRRRRWRARQRQIHSISERILVTCLGRSAEPVPLQLPPIERLNIDCSESGGTSGTQQSQGAAEGVGSPXVSGRPCTVLGSGTKKECY

SEQ ID NO: 237 - protein, 126 aa, Artificial Sequence
  Description of Artificial Sequence: Rev TV8
  SITE (108): where Xaa = subtype C premature stop
MAGRSGDSDEALLQAVRIIKILYQSNPYPRPEGTRQAQKNRRRRWRARQRQIRAISERILSTCLGRPAEPVPFQLPPIERLYIGSSESGGTSGTQQSQETTEGVGSPXVSGKSCAVLGSGTKKECY

SEQ ID NO: 238 - protein, 126 aa, Artificial Sequence
  Description of Artificial Sequence: Rev TV10
  SITE (108): where Xaa = subtype C premature stop
MAGRSGDNDEALLQAVRIIKILYQSNPYPRPEGTRQARKNRRRRWRARQRQIHKISERILSTCLGRSEEPVPFLLPPIERLHIDCSESGGTSGTQQSQGTTEGVGSPXVSGKSCAVLGSRAKKECY

SEQ ID NO: 239 - protein, 126 aa, Artificial Sequence
  Description of Artificial Sequence: Rev TV12
  SITE (108): where Xaa = subtype C premature stop
MAGRSGDNDEALLQAVRTIKILYQSNPCPKPEGTRQARKNRRRRWRARQRQIHKISERILSTCLGGLEEPVHFPLPPIEGLHIGDSESSGTSGTQQSQGTPEGVGNPXVSGESCAVLGSRAKKECC

SEQ ID NO: 240 - protein, 126 aa, Artificial Sequence
  Description of Artificial Sequence: Rev TV13
  SITE (108): where Xaa = subtype C premature stop
MAGRSGDSDEALLQAVRTIKILYQSNPYPKPEGTRQAQRNRRRRWRARQRQINSISERILSTCLGRPAEPVPLQLPPIERLHIDCGESSGTSGTEQSQGTTEGVGSPXVSGKSCAVLGSGTKKECY

SEQ ID NO: 241 - protein, 119 aa, Artificial Sequence
  Description of Artificial Sequence: Rev TV14
  SITE (101): where Xaa = subtype C premature stop
MAGRSGDNDEALLQAVRIIKILYQSNPYPKPEGTRQARKNRRRRWRARQRQIHSISERILLTCLGRSAEPVPLQLPPIERLHIDCDESGATSGAQGVGNPXISRKSWAVLGSGTKKECY

SEQ ID NO: 242 - protein, 126 aa, Artificial Sequence
  Description of Artificial Sequence: Rev TV18
  SITE (108): where Xaa = subtype C premature stop
MAGRSGDNDEALLQAVRIIKILYQSNPYPKPEGTRQARKNRRRRWRARQRQIREISERILSTCLGRPAEPVPLQLPPIERLNIDCSESSGSSGTQQSQGTTDGVGSSXVSGKPCAVLGSGAEKERY

SEQ ID NO: 243 - protein, 119 aa, Artificial Sequence
  Description of Artificial Sequence: Rev TV19
  SITE (101): where Xaa = subtype C premature stop
  SITE (115): where Xaa is a stop codon
MAGRSGDSDEALLQAVRIIKILYQSNPYPEPKGTRQAQRNRRRRWRARQRQIRSISERILSTCLGRPAEPVPFQLPPIERLHIDCSESGGNSGTQGVGSPXISGKSCAVLGSGTXKECY

SEQ ID NO: 244 - protein, 124 aa, Artificial Sequence
  Description of Artificial Sequence: Rev 92BR025
  SITE (108): where Xaa = subtype C premature stop
MAGRSGDSDEALLQAVRIIKILYQSNPYPKPEGTRQARRNRRRRWRARQRQIHSISERILSTCVGRPAEPVPFQLPPIERLNINCSESGGTSGTQQPQGNTERVGNPXVFGRPCAVLESRVKKE

SEQ ID NO: 245 - protein, 124 aa, Artificial Sequence
  Description of Artificial Sequence: Rev 301904-Ind
  SITE (108): where Xaa = subtype C premature stop
MAGRSGDSDEELLKAVRIIKILYQSNPYPEPRGTRQARKNRRRRWRARQRQIHSLSERILSACLGRPAEPVPLQLPPLERLHISGSESGGTSGTQQSQGTTERVGSPXISGKSCAVLGSGAKKE

SEQ ID NO: 246 - protein, 124 aa, Artificial Sequence
  Description of Artificial Sequence: Rev 301905-Ind
  SITE (108): where Xaa = subtype C premature stop
MAGRSGDSDEALLKAVRIIKILYQSNPYPEPRGTRQARKNRRRRWRARQKQIHSISERILSTCLGRSAEPVPLQLPPIERLHISDSESGGTSGTQQSQGTTEGMGRPXISGKSCAVLGSGAKKE

SEQ ID NO: 247 - protein, 124 aa, Artificial Sequence
  Description of Artificial Sequence: Rev 301999-Ind
  SITE (108): where Xaa = subtype C premature stop
MAGRSGDSDEALLRAVRIIKILYQSNPYPEPRGTRQARKNRRRRWRARQKQIHSLSERILSTCLGRSAEPVPLQLPPLERLHISGSESGGTSGTQQSQGTTEGVGSPXISGKSCAVLGYRAKKE

SEQ ID NO: 248 - protein, 116 aa, Artificial Sequence
  Description of Artificial Sequence: Rev 96BW16-D14
  SITE (100): where Xaa = subtype C premature stop
MAGRSGDSDAALLQAVRIIKILYQSNPYPKPKGTRQARKNRRRRWRARQRQIRAISARILSACLGRPAEPVPLQLPPLERLYIGSSESGGTSGTEVGSPXISGKPCAVLGSRAKKE

SEQ ID NO: 249 - protein, 124 aa, Artificial Sequence
  Description of Artificial Sequence: Rev 96BW04-09
  SITE (108): where Xaa = subtype C premature stop
MAGRSGDSDEALLQAVRIIKILYQSNPYPKPEGTRQARKNRRRRWRARQRQIHSISERILSTCLGRPTEPVPFQLPPIERLHIDCSESSGASGTQQSQGTTEGVGNPXVSGKSCAILGSRAKKE

SEQ ID NO: 250 - protein, 124 aa, Artificial Sequence
  Description of Artificial Sequence: Rev 96BW12-10
  SITE (108): where Xaa = subtype C premature stop
MAGRSGDSDEALLQAVRIIKILYQNNPYPKPEGTRQARKNRRRRWRARQRQIHSISERILSTCLGRPAEPVPLQLPPIERLHIGGSENSGTTGTQQSQGTTEGVGSPXISGKSCAVLGSGTKKE

SEQ ID NO: 251 - protein, 124 aa, Artificial Sequence
  Description of Artificial Sequence: Rev C2220-Eth
  SITE (108): where Xaa = subtype C premature stop
MAGRSGDSDEELLKAVRIIKILYQSNPYPTPEGTRQARRNRRRRWRARQRQIHTLSERILSNFLGRPAEPVPLQLPPLERLNLDCSEDSGTSGTQQSQGTTEGVGNPXISGKPCAVLGSGAKKE

SEQ ID NO: 252 - protein, 116 aa, Artificial Sequence
  Description of Artificial Sequence: Rev HXB2
MAGRSGDSDEELIRTVRLIKLLYQSNPPPNPEGTRQARRNRRRRWRERQRQIHSISERILGTYLGRSAEPVPLQLPPLERLTLDCNEDCGTSGTQGVGSPQILVESPTVLESGTKE

SEQ ID NO: 253 - protein, 126 aa, Artificial Sequence
  Description of Artificial Sequence: Rev Consensus
MAGRSGDSDEALLQAVRIIKILYQSNPYPKPEGTRQARKNRRRRWRARQRQIHSISERILSTCLGRPAEPVPLQLPPIERLHIDCSESGGTSGTQQSQGTTEGVGSPQVSGKSCAVLGSGAKKECY

SEQ ID NO: 254 - protein, 96 aa, Artificial Sequence
  Description of Artificial Sequence: Vpr TV007-6
MEQAPEDQGPQREPYNEWTLEILEELKQEAVRHFPRPWLHSLGQYVYETYGDTWTGVEFMIRMLQQLLFIHFRIGCQHSRIGILQQRRARHGANRS

SEQ ID NO: 255 - protein, 96 aa, Artificial Sequence; identical to SEQ ID NO: 254
  Description of Artificial Sequence: Vpr TV007-2

SEQ ID NO: 256 - protein, 96 aa, Artificial Sequence
  Description of Artificial Sequence: Vpr TV019-82
MEQPPEDQGPQREPYNEWTLELLEELKQEAVRHFPRPWLHGLGQYIYETYGDTWTGVETIIRILQQLLFIHFRIGCQHSRIGILRQRRSRNGASRS

SEQ ID NO: 257 - protein, 96 aa, Artificial Sequence; identical to SEQ ID NO: 256
  Description of Artificial Sequence: Vpr TV019-85

SEQ ID NO: 258 - protein, 96 aa, Artificial Sequence
  Description of Artificial Sequence: Vpr TV008-17
MEQAPEDQGPQREPYNEWTLEILEELKQEAVRHFPRTWLHGLGQYIYETYGDTWTGVETIIRILQQLLFIHFRIGCQHSRIGIVRQRRTRNGSSRS

SEQ ID NO: 259 - protein, 96 aa, Artificial Sequence; identical to SEQ ID NO: 258
  Description of Artificial Sequence: Vpr TV008-1

SEQ ID NO: 260 - protein, 96 aa, Artificial Sequence
  Description of Artificial Sequence: Vpr TV014-25
MEQSPEDQGPQREPYNEWTLEILEELKQEAVRHFPGPWLHNLGQYIYRTYGDTWTGVEALIRILQQLLFIHFRIGCQHSRIGILRQRRSRNGASRS

SEQ ID NO: 261 - protein, 96 aa, Artificial Sequence
  Description of Artificial Sequence: Vpr TV014-31
MEQSPEDQGPQREPYNEWTLEILEELKQEAVRHFPGPWLHNLGQYIYRTYGGTWTGVEALIRILQQLLFIHFRIGCQHSRIGILQQRRSRNGASRS

SEQ ID NO: 262 - protein, 96 aa, Artificial Sequence
  Description of Artificial Sequence: Vpr TV004-45
MEQAPEDQGPQREPYNEWTLEILEELKQEAVRHFPRPWLHSLGQYIYETYGDTWTGVEAIIRVLQQLLFIHFRIGCRHSRIGILQQRRARNGASRS

SEQ ID NO: 263 - protein, 96 aa, Artificial Sequence
  Description of Artificial Sequence: Vpr TV001-2
MEQSPEDQGPQREPYNEWTLEILEELKQEAVRHFPRPWLHSLGQYIYETYGDTWTGVEAIIRVLQQLLFIHFRIGCQHSRIGILQQRRARNGASRS

SEQ ID NO: 264 - protein, 96 aa, Artificial Sequence
  Description of Artificial Sequence: Vpr TV018-7
MEQAPEDQGPQREPYNEWTLELLEELKQEAVRHFPRPWLHSLGQYIYDTYGDTWMGVEALIRILQQLLFIHFRIGCQHSRIGIIRQRRARNGASRS

SEQ ID NO: 265 - protein, 96 aa, Artificial Sequence; identical to SEQ ID NO: 264
  Description of Artificial Sequence: Vpr TV018-8

SEQ ID NO: 266 - protein, 96 aa, Artificial Sequence; identical to SEQ ID NO: 264
  Description of Artificial Sequence: Vpr TV002-84

SEQ ID NO: 267 - protein, 96 aa, Artificial Sequence
  Description of Artificial Sequence: Vpr TV009-3
MEQVPEDQRPQREPYNEWTLELLEELKQEAVRHFPRPWLHGLGQYIYDTYGDTWTGVEAIIRILQQLLFTHFRIGCSHSRIGIMRQRRARNGASRS

SEQ ID NO: 268 - protein, 96 aa, Artificial Sequence
  Description of Artificial Sequence: Vpr TV013-2
MEQPPEDQGPQREPYNEWTLEILEELKQEAVRHFPRPWLHGLGQYIYETYGDTWTGVETIIRILQQLLFIHFRIGCQHSRIGILRQERARNGANRS

SEQ ID NO: 269 - protein, 96 aa, Artificial Sequence; identical to SEQ ID NO: 268
  Description of Artificial Sequence: Vpr TV013-3

SEQ ID NO: 270 - protein, 96 aa, Artificial Sequence
  Description of Artificial Sequence: Vpr TV003-12
MEQPPEDQGSQREPYNEWTLEILEELKQEAVRHFPRPWLHSLGQYIYDTYGDTWTGVEAIIRILQQLLFIHFRIGCQHSRIGIIRQRRARNGANRS

SEQ ID NO: 271 - protein, 96 aa, Artificial Sequence; identical to SEQ ID NO: 270
  Description of Artificial Sequence: Vpr TV003-B

SEQ ID NO: 272 - protein, 96 aa, Artificial Sequence
  Description of Artificial Sequence: Vpr TV005-81
MEQPPEDQGPQREPYNDRTLEILEELKQEAVRHFPRPWLHSLGQYIYETYGDTWAGVEALIRVLQQLLFIHFRIGCQHSRIGILRQRRARNGASRS

SEQ ID NO: 273 - protein, 96 aa, Artificial Sequence
  Description of Artificial Sequence: Vpr TV012-4
MEQAPEDQGPQREPYNEWALEILEELKQEAVRHFPRPWLHSLGQHIYNTYGDTWTGVEAIIRILQQLLFIHFRIGCQHSRIGIIRQRRARNGASRS

SEQ ID NO: 274 - protein, 96 aa, Artificial Sequence
  Description of Artificial Sequence: Vpr TV006-9
MEQVPEDQGPQREPYNEWTLEILEELKQEAVRHFPRPWLHGLGQYIYETYGDTWTGVEAIIRLLQQLLFTHFRIGCQHNRIGITRQRRARNGASRS

SEQ ID NO: 275 - protein, 96 aa, Artificial Sequence
  Description of Artificial Sequence: Vpr TV010-25
MEQAPEDQGPQREPYNEWTLEILEELKQEAVRHFPRPWLHSVGQYIYETYGDTWTGVEVIIRILQQLLFIHFRIGCPHSRIGILRHRRARNGANRS

SEQ ID NO: 276 - protein, 96 aa, Artificial Sequence
  Description of Artificial Sequence: Vpr 92BR025
MEQAPEDQGPQREPYNEWTLELLEELKREAVRHFPRPWLHGLGQHIYETYGDTWTGVEAIIRILQRLLFVHFRIGCQHSRIGILRQRRARNGASRS

SEQ ID NO: 277 - protein, 96 aa, Artificial Sequence
  Description of Artificial Sequence: Vpr 301904-Ind
MEQPPEDQGPQREPYNEWTLELLEELKQEAVRHFPRPWLHGLGQYVYETYGDTWTGVETMIRMLQQLLFIHFRIGCQHSRIGILPQRRARNGASRS

SEQ ID NO: 278 - protein, 96 aa, Artificial Sequence
  Description of Artificial Sequence: Vpr 301905-Ind
MEQSPEDQGPQREPYNEWTLELLEELKQEAVRHFPRPWLHGLGQYIYETYGDTWTGVETIIRILQQLLFIHFRIGCQHSRIGILRQRRARNGASRS

SEQ ID NO: 279 - protein, 96 aa, Artificial Sequence
  Description of Artificial Sequence: Vpr 301999-Ind
MEQPPEDQGPQREPYNEWTLELLEDLKQEAVRHFPRPWLHGLGQYVYENYGDNWTGVEILIRMLQQLLFTHFRIGCQHSRIGIWRQRRARNGASRS

SEQ ID NO: 280 - protein, 96 aa, Artificial Sequence
  Description of Artificial Sequence: Vpr 96BW16-D14
MEQPPEDQGPQREPYTEWTLELLEELKQEAVRHFPRPWLHGLGPYIYETYGDTWTGVETLIRILQQLLFIHFRIECQHSRIGILQQRRARNGARRS

SEQ ID NO: 281 - protein, 96 aa, Artificial Sequence
  Description of Artificial Sequence: Vpr 96BW04-09
MERAPEDQGPQRGPYNEWALELLEELKQEAVRRFPRMWLHGLGQYIYETYGDTWTGVEALIRTLQQLLFIHFRIGYQHSRIGILRQRRVRNGTNRS

SEQ ID NO: 282 - protein, 96 aa, Artificial Sequence
  Description of Artificial Sequence: Vpr 96BW12-10
MEQAPEDQGPQREPYNEWTLELLEELKQEAVRHFPRPWLHSLGQYIYETYGDTWTGVEVLTRILQQLLFIHFRIGCQHSRIGILRQRRTRNGASRS

SEQ ID NO: 283 - protein, 96 aa, Artificial Sequence
  Description of Artificial Sequence: Vpr C2220-Eth
MEQAPEDQGPQREPYNEWALELLEELKQEAVRHFPRPWLHNLGQYIYETYGDTWSGVEALIRTLQQLMFIHFRIGCQHSRIGILRQRRARNGASRS

SEQ ID NO: 284 - protein, 96 aa, Artificial Sequence
  Description of Artificial Sequence: Vpr HXB2
MEQAPEDQGPQREPHNEWTLELLEELKNEAVRHFPRIWLHGLGQHIYETYGDTWAGVEAIIRILQQLLFIHFRIGCRHSRIGVTRQRRARNGASRS

SEQ ID NO: 285 - protein, 96 aa, Artificial Sequence
  Description of Artificial Sequence: Vpr Consensus
MEQAPEDQGPQREPYNEWTLEILEELKQEAVRHFPRPWLHGLGQYIYETYGDTWTGVEAIIRILQQLLFIHFRIGCQHSRIGILRQRRARNGASRS

SEQ ID NO: 286 - protein, 192 aa, Artificial Sequence; identical to SEQ ID NO: 161
  Description of Artificial Sequence: Vif TV018-7

SEQ ID NO: 287 - protein, 192 aa, Artificial Sequence
  Description of Artificial Sequence: Vif Consensus
MENRWQVLIVWQVDRMRIRTWNSLVKHHMYISRRASGWFYRHHYESRHPKVSSEVHIPLGEARLVIKTYWGLQTGERDWHLGHGVSIEWRLRRYSTQVDPGLADQLIHMHYFDCFADSAIRKAILGHIVIPRCDYQAGHNKVGSLQYLALTALIKPKKIKPPLPSVRKLVEDRWNKPQKTRGRRGNHTMNGH

SEQ ID NO: 288 - protein, 85 aa, Artificial Sequence
  Description of Artificial Sequence: Vpu TV007-6
MLNLQTRIDYRLGVGALIVALIIAIVVWTIAYLEYRKLLRQRKIDWLIERIRERAEDSGNESEGDTEELSTMVDMGQLRLLDVNE

SEQ ID NO: 289 - protein, 85 aa, Artificial Sequence; identical to SEQ ID NO: 288
  Description of Artificial Sequence: Vpu TV007-2

SEQ ID NO: 290 - protein, 85 aa, Artificial Sequence
  Description of Artificial Sequence: Vpu TV019-82
  SITE (46): where Xaa is a stop codon
MVDLLAKVDYRLGVGALIVALIIAIVVWTIAYLEYRKLVRQRKIDXLIKRIRERAEDSGNESEGDTEELSTMVDMGHLRLLDNND

SEQ ID NO: 291 - protein, 85 aa, Artificial Sequence
  Description of Artificial Sequence: Vpu TV019-85
MVDLTAGVDYRLGVGALIVALIIAIVVWTIAYLEYRKLLRQRKIDWLIKRIRERAEDSGNESEGDTEELSTMVDMGHLRLLDNND

SEQ ID NO: 292 - protein, 85 aa, Artificial Sequence
  Description of Artificial Sequence: Vpu TV008-17
MLNLAARVDYRIGVGAFIVALIIAIIVWTIVYIEYRKLVRQRKIDWLIERIRERAEDSGNESDGDTEELSTMVDMGHLRLLDVND

SEQ ID NO: 293 - protein, 85 aa, Artificial Sequence; identical to SEQ ID NO: 292
  Description of Artificial Sequence: Vpu TV008-1

SEQ ID NO: 294 - protein, 82 aa, Artificial Sequence
  Description of Artificial Sequence: Vpu TV014-25
MLDLLDYRVGVGALIVALIIAIVVWTLVYIEYRKVVKQRKLDWLIKRIRERAEDSGNESEGDTEELATMVDMGNLRLLDVND

SEQ ID NO: 295 - protein, 82 aa, Artificial Sequence
  Description of Artificial Sequence: Vpu TV014-31
MLDLLDYRVGVGALIVALIIAIVVWTLVYIEYRNVVKQRKLDWLIKRIRERAEDSGNESEGDTEDLATMVDMGNLRLLDVND

SEQ ID NO: 296 - protein, 85 aa, Artificial Sequence
  Description of Artificial Sequence: Vpu TV004-45
MLSLIARVDYRLGVGALIIALILAIIVWIIAYLEYRKLVRQRKIDWLIKRIREREEDSGNESEGDTEELATMVDMGNLRLLDGND

SEQ ID NO: 297 - protein, 87 aa, Artificial Sequence
  Description of Artificial Sequence: Vpu TV001-2
MVSLSLVKGIDYRLGVGALIVALIIAIVVWTIVYIEYRKLVRQKKIDWLIKRIRERAEDSGNESDGDTEELSTMVDMGHLRLLDAND

SEQ ID NO: 298 - protein, 87 aa, Artificial Sequence
  Description of Artificial Sequence: Vpu TV018-7
MLDLNLLARVDYRVGVAALLIALIIAIVVWTIAYIEYRKLLRQRRIDKLIERIRERAEDSGNESDGDQEELSTMVDMGHLRLLGAYD

SEQ ID NO: 299 - protein, 87 aa, Artificial Sequence; identical to SEQ ID NO: 298
  Description of Artificial Sequence: Vpu TV018-8

SEQ ID NO: 300 - protein, 87 aa, Artificial Sequence
  Description of Artificial Sequence: Vpu TV002-84
MLDLNLLARVDYRVGVAALLIALIIAVVVWTIAYIEYRKLLRQRRIDKLIERIRERAEDSGNESDGDQEELSTMVDMGHLRLLGAYD

SEQ ID NO: 301 - protein, 85 aa, Artificial Sequence
  Description of Artificial Sequence: Vpu TV009-3
MINLIARVDYRIGVGALIIALIIAIIVWIIVYIEYRKLVRQRKLDWLIKRIRERAEDSGNESDGDTEELSTMVDMGHLRLLDAND

SEQ ID NO: 302 - protein, 85 aa, Artificial Sequence
  Description of Artificial Sequence: Vpu TV013-2
MLKLLTRVDYRLGVGALIIALIIAIVVWTIAYIEYRKLLRQRKIDRLIKRIRERAEDSGNESEGDTEELATMVDMGHLRLLDDND

SEQ ID NO: 303 - protein, 85 aa, Artificial Sequence
  Description of Artificial Sequence: Vpu TV013-3
MLKLLTRVDYRLGVGALIIALIIAIVVWTIAYIEYRKLLRQRKIDRLIKRIRERAEDSGNESEGDTEELATMVDMGHLRLLDDNN

SEQ ID NO: 304 - protein, 82 aa, Artificial Sequence
  Description of Artificial Sequence: Vpu TV003-12
MLAGVDYRLGVGALIIALIIAIIVWIIAYIEYRKLVKQRKINWLIERIRERAEDSGNESEGDTEELATMVDMGHLRLLDVND

SEQ ID NO: 305 - protein, 82 aa, Artificial Sequence
  Description of Artificial Sequence: Vpu TV003-B
MLAEVDYRLGVGALIIALIIAIIVWIIAYIEYRKLVKQRKINWLIERIRERAEDSGNESEGDTEELATMVDMGHLRLLDVND

SEQ ID NO: 306 - protein, 85 aa, Artificial Sequence
  Description of Artificial Sequence: Vpu TV005-81
MLNLLEQVDYRIGVGALIIALILAIIVWTIAYLEYRKLVTQKRIDWLVKRIRERAEDSGNESEGDTEELATMVDMGHLRLLDDND

SEQ ID NO: 307 - protein, 83 aa, Artificial Sequence
  Description of Artificial Sequence: Vpu TV006-9
MLDLLARVDYRVGVAAFTVGLIIAIIVWTIVYIEYRKIVRQRKIDWLIRRIRERAEDRGNESEGDTEELSTMVDMGHLRLLDN

SEQ ID NO: 308 - protein, 85 aa, Artificial Sequence
  Description of Artificial Sequence: Vpu TV012-4
MLNFLEKVDYKIGVAALIIALIIAIVVWTIVYIEYRQLLRQKRIDWLIERIRERAEDSGNESDGEQEELSTMVDMGNLRLLDANG

SEQ ID NO: 309 - protein, 83 aa, Artificial Sequence
  Description of Artificial Sequence: Vpu TV010-25
MLDLLARVDYRLGVGALIVALIIAIVVWTIAYIEYRKLLRREKIDWLIKRIRERAEDSSNESDGDTEELSTMVDMGHLRLLDD

SEQ ID NO: 310 - protein, 85 aa, Artificial Sequence
  Description of Artificial Sequence: Vpu 92BR025
MLELIGRIDYRLGVGALIVALIIVIIVWTIAYIEYRKLVRQRRIDWLVKRIKERAEDSGNESGGDTEELETMVDMGHLRLLDGND

SEQ ID NO: 311 - protein, 81 aa, Artificial Sequence
  Description of Artificial Sequence: Vpu 301904-Ind
MLDLDYKLAVGALIVALIIAIVVWIIAYIEYRKLVKQRKIDWLIKRIRERAEDSGNESEGDTEELSTMVDMGRLRLLDVND

SEQ ID NO: 312 - protein, 81 aa, Artificial Sequence
  Description of Artificial Sequence: Vpu 301905-Ind
MLDLDYKLGVGALIVALIIVIVVWTIVYIEYRRLVKQRKIDWLIKRIRERAEDSGNESEGDTEELSTMVDMGRLRLLDVND

SEQ ID NO: 313 - protein, 81 aa, Artificial Sequence
  Description of Artificial Sequence: Vpu 301999-Ind
IIDLDYRLGVGALIVAFIIAIVVWTIVYIKYRKLLRQRRIDWLIKRIRERAEDSGNESEGDTEELSTMVDMGHLRLLDVND

SEQ ID NO: 314 - protein, 85 aa, Artificial Sequence
  Description of Artificial Sequence: Vpu 96BW16-D14
MFSLIEKVDYRLGVGALIVAIIIAIIVWIIAYIEYRKLLRQKKIDRLIERIRERAEDSGNDSEGDIEDLSTMVDMDHLRLLDINN

SEQ ID NO: 315 - protein, 82 aa, Artificial Sequence
  Description of Artificial Sequence: Vpu 96BW04-09
MLSLAAIDYRIGVGAFVVALIIAIIVWIIVYIEYRKLVRQRKIDWLVKRIRERAEDSGNESDGDTEELSTMVDMGHLRLLDD

SEQ ID NO: 316 - protein, 85 aa, Artificial Sequence
  Description of Artificial Sequence: Vpu 96BW12-10
MLYLLEKVDYRLGVGALIIALIIAIIVWTIAYLEYRKVLRQRRIDRLVERIREREEDSGNESEGDIEELSTMVDMGHLRLLDADG

SEQ ID NO: 317 - protein, 85 aa, Artificial Sequence
  Description of Artificial Sequence: Vpu C2220-Eth
MVDLLAKVDYRIVIVAFIVALIIAIVVWTIAYIEYRKLLRQRRIDRLIKRTRERAEDSGNESDGDTEELSTMVDMGNLRLLDVND

SEQ ID NO: 318 - protein, 81 aa, Artificial Sequence
  Description of Artificial Sequence: Vpu HXB2
TQPIPIVAIVALVVAIIIAIVVWSIVIIEYRKILRQRKIDRLIDRLIERAEDSGNESEGEISALVEMGVEMGHHAPWDVDD

SEQ ID NO: 319 - protein, 87 aa, Artificial Sequence
  Description of Artificial Sequence: Vpu Consensus
MLDLNLLARVDYRLGVGALIVALIIAIVVWTIAYIEYRKLVRQRKIDWLIKRIRERAEDSGNESEGDTEELSTMVDMGHLRLLDVND

What is claimed is:

1. An expression cassette, comprising a polynucleotide sequence encoding a polypeptide including an immunogenic HIV Gag polypeptide, wherein the polynucleotide sequence encoding said immunogenic HIV Gag polypeptide comprises a sequence having at least 90% sequence identity to SEQ ID NO:9.

2. A recombinant expression system for use in a selected host cell, comprising, an expression cassette of claim 1, and wherein said polynucleotide sequence is operably linked to control elements compatible with expression in the selected host cell.

3. The recombinant expression system of claim 2, wherein said control elements are selected from the group consisting of a transcription promoter, a transcription enhancer element, a transcription termination signal, polyadenylation sequences, sequences for optimization of initiation of translation, and translation termination sequences.

4. The recombinant expression system of claim 2, wherein said transcription promoter is selected from the group consisting of CMV, CMV+intron A, SV40, RSV, HJV-Ltr, MMLV-ltr, and metallothionein.

5. A cell comprising an expression cassette of claim 1, and wherein said polynucleotide sequence is operably linked to control elements compatible with expression in the selected cell.

6. The cell of claim 5, wherein the cell is a mammalian cell.

7. The cell of claim 6, wherein the cell is selected from the group consisting of BHK, VERO, HT1080, 293, RD, COS-7, and CHO cells.

8. The cell of claim 7, wherein said cell is a CHO cell.

9. The cell of claim 5, wherein the cell is an insect cell.

10. The cell of claim 9, wherein the cell is either *Trichoplusia ni* (Tn5) or Sf9 insect cells.

11. The cell of claim 5, wherein the cell is a bacterial cell.

12. The cell of claim 5, wherein the cell is a yeast cell.

13. The cell of claim 5, wherein the cell is a plant cell.

14. The cell of claim 5, wherein the cell is an antigen presenting cell.

15. The cell of claim 14, wherein the antigen presenting cell is a lymphoid cell selected from the group consisting of macrophages, monocytes, dendritic cells, B-cells, T-cells, stem cells, and progenitor cells thereof.

16. The cell of claim 5, wherein the cell is a primary cell.

17. The cell of claim 5, Wherein the cell is an immortalized cell.

18. The cell of claim 5, wherein the cell is a tumor-derived cell.

19. A method for producing a polypeptide including HIV Gag polypeptide sequences, said method comprising,
incubating the cells of claim 5, under conditions for producing said polypeptide.

20. A vector for use in a mammalian subject, wherein the vector comprises an expression cassette of claim 1, and wherein said polynucleotide sequence is operably linked to control elements compatible with expression in the subject.

21. A method of DNA immunization of a subject, comprising,
introducing a vector of claim 20 into said subject under conditions that are compatible with expression of said expression cassette in said subject.

22. The method of claim 21, wherein said vector is a nonviral vector.

23. The method of claim 21, wherein said vector is delivered using a particulate carrier.

24. The method of claim 23, wherein said vector is coated on a gold or tungsten particle and said coated particle is delivered to said subject using a gene gun.

25. The method of claim 21, wherein said vector is encapsulated in a liposome preparation.

26. The method of claim 21, wherein said vector is a viral vector.

27. The method of claim 26, wherein said viral vector is a retroviral vector.

28. The method of claim 26, wherein said viral vector is an alphaviral vector.

29. The method of claim 26, wherein said viral vector is a lentiviral vector.

30. The method of claim 21, wherein said subject is a mammal.

31. The method of claim 30, wherein said mammal is a human.

32. A method of generating an immune response in a subject, comprising transfecting cells of said subject with a vector of claim 20, under conditions that permit the expression of said polynucleotide and production of said polypeptide, thereby eliciting an immunological response to said polypeptide.

33. The method of claim 32, wherein said vector is a nonviral vector.

34. The method of claim 32, wherein said vector is delivered using a particulate carrier.

35. The method of claim 32, wherein said vector is coated on a gold or tungsten particle and said coated particle is delivered to said vertebrate cell using a gene gun.

36. The method of claim 32, wherein said vector is encapsulated in a liposome preparation.

37. The method of claim 32, wherein said vector is a viral vector.

38. The method of claim 37, wherein said viral vector is a retroviral vector.

39. The method of claim 37, wherein said viral vector is an alphaviral vector.

40. The method of claim 37, wherein said viral vector is a lentiviral vector.

41. The method of claim 32, wherein said subject is a mammal.

42. The method of claim 41, wherein said mammal is a human.

43. The method of claim 32, wherein said transfecting is done ex vivo and said transfected cells are reintroduced into said subject.

44. The method of claim 32, wherein said transfecting is done in vivo in said subject.

45. The method of claim 32, where said immune response is a humoral immune response.

46. The method of claim 32, where said immune response is a cellular immune response.

47. The method of claim 32, wherein the vector is administered intramuscularly, intramucosally, intranasally, subcutaneously, intradermally, transdermally, intravaginally, intrarectally, orally or intravenously.

* * * * *